(12) United States Patent
Cotta-Ramusino et al.

(10) Patent No.: US 11,597,924 B2
(45) Date of Patent: Mar. 7, 2023

(54) GENOME EDITING SYSTEMS COMPRISING REPAIR-MODULATING ENZYME MOLECULES AND METHODS OF THEIR USE

(71) Applicant: Editas Medicine, Inc., Cambridge, MA (US)

(72) Inventors: Cecilia Cotta-Ramusino, Cambridge, MA (US); Anne Helen Bothmer, Cambridge, MA (US)

(73) Assignee: Editas Medicine, Inc., Cambridge, MA (US)

( * ) Notice: Subject to any disclaimer, the term of this patent is extended or adjusted under 35 U.S.C. 154(b) by 757 days.

(21) Appl. No.: 16/088,159

(22) PCT Filed: Mar. 24, 2017

(86) PCT No.: PCT/US2017/024110
§ 371 (c)(1),
(2) Date: Sep. 25, 2018

(87) PCT Pub. No.: WO2017/165826
PCT Pub. Date: Sep. 28, 2017

(65) Prior Publication Data
US 2019/0345490 A1    Nov. 14, 2019

Related U.S. Application Data

(60) Provisional application No. 62/313,247, filed on Mar. 25, 2016.

(51) Int. Cl.
| C12N 15/11 | (2006.01) |
| C12N 9/22 | (2006.01) |
| A61K 31/7088 | (2006.01) |
| A61K 38/45 | (2006.01) |
| A61K 38/46 | (2006.01) |
| A61K 48/00 | (2006.01) |
| C12N 9/12 | (2006.01) |

(52) U.S. Cl.
CPC .......... *C12N 15/11* (2013.01); *A61K 31/7088* (2013.01); *A61K 38/45* (2013.01); *A61K 38/465* (2013.01); *A61K 48/005* (2013.01); *C12N 9/1264* (2013.01); *C12N 9/22* (2013.01); *C12Y 207/07031* (2013.01); *C12Y 301/16001* (2013.01); *C12N 2310/20* (2017.05); *C12N 2800/80* (2013.01)

(58) Field of Classification Search
CPC ........ C12N 15/11; C12N 9/1264; C12N 9/22; C12N 2310/20; C12N 2800/80; A61K 31/7088; A61K 38/45; A61K 38/465; A61K 38/005; C12Y 207/07031; C12Y 301/16001
See application file for complete search history.

(56) References Cited

U.S. PATENT DOCUMENTS

| 8,546,553 | B2 | 10/2013 | Terns et al. |
| 8,697,359 | B1 | 4/2014 | Zhang |
| 8,771,945 | B1 | 7/2014 | Zhang |
| 8,795,965 | B2 | 8/2014 | Zhang |
| 8,865,406 | B2 | 10/2014 | Zhang et al. |
| 8,871,445 | B2 | 10/2014 | Cong et al. |
| 8,889,356 | B2 | 11/2014 | Zhang |
| 8,889,418 | B2 | 11/2014 | Zhang et al. |
| 8,895,308 | B1 | 11/2014 | Zhang et al. |
| 8,906,616 | B2 | 12/2014 | Zhang et al. |
| 8,932,814 | B2 | 1/2015 | Cong et al. |
| 8,945,839 | B2 | 2/2015 | Zhang |
| 8,993,233 | B2 | 3/2015 | Zhang et al. |
| 8,999,641 | B2 | 4/2015 | Zhang et al. |
| 9,023,649 | B2 | 5/2015 | Mali et al. |
| 9,074,199 | B1 | 7/2015 | Chavez et al. |
| 9,228,208 | B2 | 1/2016 | Frendewey et al. |
| 9,234,213 | B2 | 1/2016 | Wu |
| 9,260,723 | B2 | 2/2016 | Mali et al. |
| 9,260,752 | B1 | 2/2016 | May et al. |
| 9,267,135 | B2 | 2/2016 | Church et al. |
| 9,322,037 | B2 | 4/2016 | Liu et al. |
| 9,388,430 | B2 | 7/2016 | Liu et al. |
| 9,404,098 | B2 | 8/2016 | Terns et al. |
| 9,410,198 | B2 | 8/2016 | May et al. |
| 9,422,553 | B2 | 8/2016 | Terns et al. |
| 9,476,065 | B2 | 10/2016 | Horwitz et al. |
| 9,493,844 | B2 | 11/2016 | Sastry-Dent et al. |
| 9,512,444 | B2 | 12/2016 | Chen et al. |
| 9,512,446 | B1 | 12/2016 | Joung et al. |
| 9,528,124 | B2 | 12/2016 | Fahrenkrug et al. |
| 9,546,384 | B2 | 1/2017 | Frendewey et al. |
| 9,567,603 | B2 | 2/2017 | Joung et al. |
| 9,567,604 | B2 | 2/2017 | Joung et al. |
| 9,587,252 | B2 | 3/2017 | Church et al. |
| 9,637,739 | B2 | 5/2017 | Šikšnys et al. |
| 9,663,782 | B2 | 5/2017 | Yu et al. |
| 9,688,971 | B2 | 6/2017 | Doudna et al. |
| 9,725,714 | B2 | 8/2017 | May et al. |
| 9,738,908 | B2 | 8/2017 | Wu |
| 9,752,132 | B2 | 9/2017 | Joung et al. |
| 9,790,490 | B2 | 10/2017 | Zhang et al. |
| 9,803,194 | B2 | 10/2017 | May et al. |
| 9,809,814 | B1 | 11/2017 | May et al. |
| 9,822,370 | B2 | 11/2017 | Musunuru et al. |
| 9,822,372 | B2 | 11/2017 | Zhang et al. |
| 9,840,713 | B2 | 12/2017 | Zhang |

(Continued)

FOREIGN PATENT DOCUMENTS

| WO | WO-2007/025097 A2 | 3/2007 |
| WO | WO-2010/011961 A2 | 1/2010 |

(Continued)

OTHER PUBLICATIONS

US 10,077,445 B2, 09/2018, Doudna et al. (withdrawn)

(Continued)

*Primary Examiner* — Antonio Galisteo Gonzalez
*Assistant Examiner* — Khaleda B Hasan
(74) *Attorney, Agent, or Firm* — McCarter & English, LLP; Maria Laccotripe Zacharakis; Marcie B. Clarke

(57) ABSTRACT

The application provides improved methods of genome editing. The genome editing systems described herein comprise a RNA-guided nuclease molecule and a Repair-Modulating Enzyme Molecule (RMEM).

19 Claims, 13 Drawing Sheets

Specification includes a Sequence Listing.

(56) References Cited

U.S. PATENT DOCUMENTS

| | | |
|---|---|---|
| 9,873,894 B2 | 1/2018 | Conway et al. |
| 9,879,269 B2 | 1/2018 | Barrangou et al. |
| 9,885,026 B2 | 2/2018 | Brouns et al. |
| 9,902,974 B2 | 2/2018 | Conway et al. |
| 9,909,122 B2 | 3/2018 | May et al. |
| 9,926,545 B2 | 3/2018 | Joung et al. |
| 9,926,546 B2 | 3/2018 | Joung et al. |
| 9,944,912 B2 | 4/2018 | Joung et al. |
| 9,963,689 B2 | 5/2018 | Doudna et al. |
| 9,970,001 B2 | 5/2018 | Miller |
| 9,970,024 B2 | 5/2018 | Church et al. |
| 9,970,028 B2 | 5/2018 | Cost et al. |
| 10,041,092 B2 | 8/2018 | Horwitz et al. |
| 10,066,233 B2 | 9/2018 | Barrangou et al. |
| 10,077,453 B2 | 9/2018 | Liu et al. |
| 10,093,910 B2 | 10/2018 | Joung et al. |
| 10,100,291 B2 | 10/2018 | Chavez et al. |
| 10,113,167 B2 | 10/2018 | Doudna et al. |
| 10,113,179 B2 | 10/2018 | Begemann et al. |
| 10,113,207 B2 | 10/2018 | Wang |
| 10,119,133 B2 | 11/2018 | Joung et al. |
| 10,125,361 B2 | 11/2018 | May et al. |
| 2010/0076057 A1 | 3/2010 | Sontheimer et al. |
| 2010/0093617 A1 | 4/2010 | Barrangou et al. |
| 2013/0011828 A1 | 1/2013 | Barrangou et al. |
| 2014/0068797 A1 | 3/2014 | Doudna et al. |
| 2014/0093941 A1 | 4/2014 | Terns et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0199767 A1 | 7/2014 | Barrangou et al. |
| 2014/0242664 A1 | 8/2014 | Zhang et al. |
| 2014/0242699 A1 | 8/2014 | Zhang |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273233 A1 | 9/2014 | Chen et al. |
| 2014/0287938 A1 | 9/2014 | Zhang et al. |
| 2014/0294773 A1 | 10/2014 | Brouns et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356956 A1 | 12/2014 | Church et al. |
| 2014/0357523 A1 | 12/2014 | Zeiner et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0071889 A1 | 3/2015 | Musunuru et al. |
| 2015/0071898 A1 | 3/2015 | Liu et al. |
| 2015/0071899 A1 | 3/2015 | Liu et al. |
| 2015/0079680 A1 | 3/2015 | Bradley et al. |
| 2015/0079681 A1 | 3/2015 | Zhang |
| 2015/0128300 A1 | 5/2015 | Warming et al. |
| 2015/0140664 A1 | 5/2015 | Byrne et al. |
| 2015/0159174 A1 | 6/2015 | Frendewey et al. |
| 2015/0159175 A1 | 6/2015 | Frendewey et al. |
| 2015/0176013 A1 | 6/2015 | Musunuru et al. |
| 2015/0184139 A1 | 7/2015 | Zhang et al. |
| 2015/0184199 A1 | 7/2015 | Horwitz et al. |
| 2015/0203872 A1 | 7/2015 | Zhang |
| 2015/0232833 A1 | 8/2015 | Mali et al. |
| 2015/0232882 A1 | 8/2015 | Zhang et al. |
| 2015/0240261 A1 | 8/2015 | Siksnys et al. |
| 2015/0240263 A1 | 8/2015 | Holmes et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0353905 A1 | 12/2015 | Weiss et al. |
| 2015/0353917 A1 | 12/2015 | Miller |
| 2015/0356239 A1 | 12/2015 | Zhang et al. |
| 2015/0376645 A1 | 12/2015 | Zechiedrich et al. |
| 2016/0002670 A1 | 1/2016 | Church et al. |
| 2016/0010076 A1 | 1/2016 | Joung et al. |
| 2016/0010154 A1 | 1/2016 | Laganiere et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0024529 A1 | 1/2016 | Carstens |
| 2016/0029604 A1 | 2/2016 | Fahrenkrug et al. |
| 2016/0032274 A1 | 2/2016 | Church et al. |
| 2016/0032292 A1 | 2/2016 | Storici et al. |
| 2016/0040155 A1 | 2/2016 | Maizels et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0046963 A1 | 2/2016 | May et al. |
| 2016/0046978 A1 | 2/2016 | May et al. |
| 2016/0060653 A1 | 3/2016 | Doudna et al. |
| 2016/0060654 A1 | 3/2016 | Doudna et al. |
| 2016/0060657 A1 | 3/2016 | Frendewey et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0090607 A1 | 3/2016 | Conway et al. |
| 2016/0102324 A1 | 4/2016 | Duchateau et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0122774 A1 | 5/2016 | Duchateau et al. |
| 2016/0130608 A1 | 5/2016 | Doudna et al. |
| 2016/0130609 A1 | 5/2016 | Doudna et al. |
| 2016/0138008 A1 | 5/2016 | Doudna et al. |
| 2016/0138046 A1 | 5/2016 | Wu |
| 2016/0145644 A1 | 5/2016 | Cost et al. |
| 2016/0145646 A1 | 5/2016 | Frendewey et al. |
| 2016/0153003 A1 | 6/2016 | Joung et al. |
| 2016/0153004 A1 | 6/2016 | Zhang et al. |
| 2016/0153006 A1 | 6/2016 | Zhang et al. |
| 2016/0160210 A1 | 6/2016 | Mali et al. |
| 2016/0160291 A1 | 6/2016 | Scully et al. |
| 2016/0168592 A1 | 6/2016 | Church et al. |
| 2016/0175462 A1 | 6/2016 | Zhang et al. |
| 2016/0177340 A1 | 6/2016 | Bradley et al. |
| 2016/0184362 A1 | 6/2016 | Duchateau et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0201089 A1 | 7/2016 | Gersbach et al. |
| 2016/0207983 A1 | 7/2016 | Bradley et al. |
| 2016/0208243 A1 | 7/2016 | Zhang et al. |
| 2016/0215276 A1 | 7/2016 | Liu et al. |
| 2016/0222416 A1 | 8/2016 | Church et al. |
| 2016/0237455 A1 | 8/2016 | Glucksmann et al. |
| 2016/0237456 A1 | 8/2016 | Church et al. |
| 2016/0251640 A1 | 9/2016 | May et al. |
| 2016/0257948 A1 | 9/2016 | Bradley et al. |
| 2016/0257974 A1 | 9/2016 | Bradley et al. |
| 2016/0264995 A1 | 9/2016 | Yamamoto et al. |
| 2016/0272965 A1 | 9/2016 | Zhang et al. |
| 2016/0281072 A1 | 9/2016 | Zhang |
| 2016/0281111 A1 | 9/2016 | Cotta-Ramusino et al. |
| 2016/0298097 A1 | 10/2016 | Chavez et al. |
| 2016/0298125 A1 | 10/2016 | Chen et al. |

(56) References Cited

U.S. PATENT DOCUMENTS

| | | |
|---|---|---|
| 2016/0298132 A1 | 10/2016 | Chen et al. |
| 2016/0298133 A1 | 10/2016 | Chen et al. |
| 2016/0298134 A1 | 10/2016 | Chen et al. |
| 2016/0298135 A1 | 10/2016 | Chen et al. |
| 2016/0298136 A1 | 10/2016 | Chen et al. |
| 2016/0298137 A1 | 10/2016 | Chen et al. |
| 2016/0298138 A1 | 10/2016 | Chen et al. |
| 2016/0304855 A1 | 10/2016 | Stark et al. |
| 2016/0304907 A1 | 10/2016 | Mali et al. |
| 2016/0312198 A1 | 10/2016 | Joung et al. |
| 2016/0312199 A1 | 10/2016 | Joung et al. |
| 2016/0312280 A1 | 10/2016 | May et al. |
| 2016/0319260 A1 | 11/2016 | Joung et al. |
| 2016/0319261 A1 | 11/2016 | Joung et al. |
| 2016/0319281 A1 | 11/2016 | Tsai et al. |
| 2016/0319349 A1 | 11/2016 | May et al. |
| 2016/0340662 A1 | 11/2016 | Zhang et al. |
| 2016/0355796 A1 | 12/2016 | Davidson et al. |
| 2016/0355797 A1 | 12/2016 | Konermann et al. |
| 2016/0355816 A1 | 12/2016 | Terns et al. |
| 2016/0369258 A1 | 12/2016 | Maizels et al. |
| 2016/0376610 A1 | 12/2016 | Davis et al. |
| 2017/0002380 A1 | 1/2017 | Bueckstuemmer |
| 2017/0009256 A1 | 1/2017 | Bueckstuemmer |
| 2017/0016027 A1 | 1/2017 | Lee et al. |
| 2017/0029805 A1 | 2/2017 | Li et al. |
| 2017/0037416 A1 | 2/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0058299 A1 | 3/2017 | Horwitz et al. |
| 2017/0067078 A1 | 3/2017 | Frendewey et al. |
| 2017/0073705 A1 | 3/2017 | Chen et al. |
| 2017/0081650 A1 | 3/2017 | Joung et al. |
| 2017/0107536 A1 | 4/2017 | Zhang et al. |
| 2017/0152508 A1 | 6/2017 | Joung et al. |
| 2017/0152528 A1 | 6/2017 | Zhang |
| 2017/0166875 A1 | 6/2017 | Maizels et al. |
| 2017/0166893 A1 | 6/2017 | Doudna et al. |
| 2017/0166903 A1 | 6/2017 | Zhang et al. |
| 2017/0175140 A1 | 6/2017 | Hummel et al. |
| 2017/0175142 A1 | 6/2017 | Zhang et al. |
| 2017/0175144 A1 | 6/2017 | Zhang et al. |
| 2017/0191078 A1 | 7/2017 | Zhang et al. |
| 2017/0191082 A1 | 7/2017 | Chen et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211142 A1 | 7/2017 | Smargon et al. |
| 2017/0233703 A1 | 8/2017 | Xie et al. |
| 2017/0251647 A1 | 9/2017 | Mashimo et al. |
| 2017/0260547 A1 | 9/2017 | Dombrowski et al. |
| 2017/0268022 A1 | 9/2017 | Liu et al. |
| 2017/0273284 A1 | 9/2017 | Shen |
| 2017/0275611 A1 | 9/2017 | Bradley et al. |
| 2017/0298330 A1 | 10/2017 | Sato et al. |
| 2017/0306306 A1 | 10/2017 | Potter et al. |
| 2017/0306307 A1 | 10/2017 | Zhang et al. |
| 2017/0306335 A1 | 10/2017 | Zhang et al. |
| 2017/0327805 A1 | 11/2017 | Joung et al. |
| 2017/0327806 A1 | 11/2017 | Joung et al. |
| 2017/0327820 A1 | 11/2017 | May et al. |
| 2017/0349915 A1 | 12/2017 | May et al. |
| 2017/0362611 A1 | 12/2017 | Tsai |
| 2018/0002682 A1 | 1/2018 | Sternberg et al. |
| 2018/0016601 A1 | 1/2018 | Qi et al. |
| 2018/0030425 A1 | 2/2018 | Joung et al. |
| 2018/0044700 A1 | 2/2018 | Doudna et al. |
| 2018/0049412 A1 | 2/2018 | Shen |
| 2018/0051298 A1 | 2/2018 | Fahrenkrug et al. |
| 2018/0066242 A1 | 3/2018 | Zhang et al. |
| 2018/0073002 A1 | 3/2018 | Deiters et al. |
| 2018/0073039 A1 | 3/2018 | Durocher et al. |
| 2018/0080051 A1 | 3/2018 | Sheikh et al. |
| 2018/0100148 A1 | 4/2018 | Vakulskas et al. |
| 2018/0105564 A1 | 4/2018 | Davis et al. |
| 2018/0112235 A1 | 4/2018 | Li et al. |
| 2018/0119121 A1 | 5/2018 | Brouns et al. |
| 2018/0119175 A1 | 5/2018 | Conway et al. |
| 2018/0127780 A1 | 5/2018 | Liu et al. |
| 2018/0127785 A1 | 5/2018 | Junge et al. |
| 2018/0127787 A1 | 5/2018 | Gurumurthy et al. |
| 2018/0135073 A1 | 5/2018 | Chen et al. |
| 2018/0142262 A1 | 5/2018 | Webber et al. |
| 2018/0148735 A1 | 5/2018 | Begemann et al. |
| 2018/0155708 A1 | 6/2018 | Church et al. |
| 2018/0155716 A1 | 6/2018 | Zhang et al. |
| 2018/0163188 A1 | 6/2018 | Xie et al. |
| 2018/0163213 A1 | 6/2018 | Aneja et al. |
| 2018/0187176 A1 | 7/2018 | Behlke et al. |
| 2018/0187195 A1 | 7/2018 | Siksnys et al. |
| 2018/0208931 A1 | 7/2018 | Doudna et al. |
| 2018/0216088 A1 | 8/2018 | Joung et al. |
| 2018/0216135 A1 | 8/2018 | Tsai et al. |
| 2018/0230494 A1 | 8/2018 | Joung et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0235194 A1 | 8/2018 | Fahrenkrug et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0250424 A1 | 9/2018 | Cotta-Ramusino |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0265864 A1 | 9/2018 | Li et al. |
| 2018/0273932 A1 | 9/2018 | Bothmer et al. |
| 2018/0273981 A1 | 9/2018 | Doudna et al. |
| 2018/0282713 A1 | 10/2018 | Van Der Oost |
| 2018/0282714 A1 | 10/2018 | Joung et al. |
| 2018/0282764 A1 | 10/2018 | Jinek et al. |
| 2018/0291383 A1 | 10/2018 | Musunuru et al. |
| 2018/0298360 A1 | 10/2018 | Sternberg et al. |
| 2018/0298392 A1 | 10/2018 | Cotta-Ramusino |
| 2018/0298406 A1 | 10/2018 | Doudna et al. |
| 2018/0298407 A1 | 10/2018 | Doudna et al. |
| 2018/0305697 A1 | 10/2018 | Sfeir et al. |
| 2018/0305718 A1 | 10/2018 | Nelson et al. |
| 2018/0305719 A1 | 10/2018 | Perez-Pinera et al. |
| 2018/0312824 A1 | 11/2018 | Zhang et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |
| 2018/0320163 A1 | 11/2018 | Koonin et al. |
| 2018/0320197 A1 | 11/2018 | Gersbach et al. |
| 2018/0320201 A1 | 11/2018 | Vakulskas et al. |
| 2018/0327761 A1 | 11/2018 | Duchateau et al. |

FOREIGN PATENT DOCUMENTS

| | | |
|---|---|---|
| WO | WO-2013/098244 A1 | 7/2013 |
| WO | WO-2013/141680 A1 | 9/2013 |
| WO | WO-2013/142578 A1 | 9/2013 |
| WO | WO-2013/176772 A1 | 11/2013 |
| WO | WO-2013/188522 A2 | 12/2013 |
| WO | WO-2014/018423 A2 | 1/2014 |
| WO | WO-2014/065596 A1 | 5/2014 |
| WO | WO-2014/089290 A1 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |

(56) References Cited

FOREIGN PATENT DOCUMENTS

| | | | |
|---|---|---|---|
| WO | WO-2014/093718 A1 | 6/2014 | |
| WO | WO-2014/099744 A1 | 6/2014 | |
| WO | WO-2014/099750 A2 | 6/2014 | |
| WO | WO-2014/113493 A1 | 7/2014 | |
| WO | 2014/130955 A1 | 8/2014 | |
| WO | WO-2014/127287 A1 | 8/2014 | |
| WO | WO-2014130955 A1 * | 8/2014 | ............... C12N 9/22 |
| WO | WO-2014/143381 A1 | 9/2014 | |
| WO | WO-2014/144288 A1 | 9/2014 | |
| WO | WO-2014/144592 A2 | 9/2014 | |
| WO | WO-2014/144761 A2 | 9/2014 | |
| WO | WO-2014/145599 A2 | 9/2014 | |
| WO | WO-2014/150624 A1 | 9/2014 | |
| WO | WO-2014/152432 A2 | 9/2014 | |
| WO | WO-2014/165825 A2 | 10/2014 | |
| WO | WO-2014/172458 A1 | 10/2014 | |
| WO | WO-2014/186585 A2 | 11/2014 | |
| WO | 2014/201015 A2 | 12/2014 | |
| WO | WO-2014/191518 A1 | 12/2014 | |
| WO | WO-2014/191521 A2 | 12/2014 | |
| WO | WO-2014/197568 A2 | 12/2014 | |
| WO | WO-2014/197748 A2 | 12/2014 | |
| WO | WO-2014/204578 A1 | 12/2014 | |
| WO | WO-2014/204724 A1 | 12/2014 | |
| WO | WO-2014/204725 A1 | 12/2014 | |
| WO | WO-2014/204727 A1 | 12/2014 | |
| WO | WO-2014/204728 A1 | 12/2014 | |
| WO | WO-2014/204729 A1 | 12/2014 | |
| WO | WO-2014201015 A2 * | 12/2014 | ........... C12N 15/902 |
| WO | WO-2015/006290 A1 | 1/2015 | |
| WO | WO-2015/010114 A1 | 1/2015 | |
| WO | WO-2015/013583 A2 | 1/2015 | |
| WO | WO-2015/021426 A1 | 2/2015 | |
| WO | WO-2015/035162 A2 | 3/2015 | |
| WO | WO-2015/040402 A1 | 3/2015 | |
| WO | WO-2015/048577 A2 | 4/2015 | |
| WO | WO-2015/077290 A2 | 5/2015 | |
| WO | WO-2015/077318 A1 | 5/2015 | |
| WO | WO-2015/079056 A1 | 6/2015 | |
| WO | WO-2015/088643 A1 | 6/2015 | |
| WO | WO-2015/089351 A1 | 6/2015 | |
| WO | WO-2015/089354 A1 | 6/2015 | |
| WO | WO-2015/089427 A1 | 6/2015 | |
| WO | WO-2015/089486 A2 | 6/2015 | |
| WO | WO-2015/095804 A1 | 6/2015 | |
| WO | WO-2015/127439 A1 | 8/2015 | |
| WO | WO-2015/138620 A1 | 9/2015 | |
| WO | WO-2015/160683 A1 | 10/2015 | |
| WO | WO-2015/168125 A1 | 11/2015 | |
| WO | WO-2015/188056 A1 | 12/2015 | |
| WO | WO-2015/188065 A1 | 12/2015 | |
| WO | WO-2016/022363 A2 | 2/2016 | |
| WO | WO-2016/025759 A1 | 2/2016 | |
| WO | WO-2016/028682 A1 | 2/2016 | |
| WO | WO-2016/036754 A1 | 3/2016 | |
| WO | WO-2016/054326 A1 | 4/2016 | |
| WO | WO-2016/057821 A2 | 4/2016 | |
| WO | WO-2016/057961 A1 | 4/2016 | |
| WO | WO-2016/065364 A1 | 4/2016 | |
| WO | WO-2016/073990 A2 | 5/2016 | |
| WO | WO-2016/081923 A2 | 5/2016 | |
| WO | WO-2016/090385 A1 | 6/2016 | |
| WO | WO-2016/100819 A1 | 6/2016 | |
| WO | WO-2016/106236 A1 | 6/2016 | |
| WO | WO-2016/106244 A1 | 6/2016 | |
| WO | WO-2016/112242 A1 | 7/2016 | |
| WO | WO-2016/114972 A1 | 7/2016 | |
| WO | WO-2016/115326 A1 | 7/2016 | |
| WO | WO-2016/138574 A1 | 9/2016 | |
| WO | WO-2016/141224 A1 | 9/2016 | |
| WO | WO-2016/142719 A1 | 9/2016 | |
| WO | WO-2016/154579 A2 | 9/2016 | |
| WO | WO-2016/161207 A1 | 10/2016 | |
| WO | WO-2016/164797 A1 | 10/2016 | |
| WO | WO-2016/166340 A1 | 10/2016 | |
| WO | WO-2016/167300 A1 | 10/2016 | |
| WO | WO-2016/183448 A1 | 11/2016 | |
| WO | WO-2016/195598 A1 | 12/2016 | |
| WO | WO-2016/196655 A1 | 12/2016 | |
| WO | WO-2016/196887 A1 | 12/2016 | |
| WO | WO-2016/205613 A1 | 12/2016 | |
| WO | WO-2016/205711 A1 | 12/2016 | |
| WO | WO-2016/205749 A1 | 12/2016 | |
| WO | WO-2016/205759 A1 | 12/2016 | |
| WO | WO-2016/210271 A1 | 12/2016 | |
| WO | WO-2017/011519 A1 | 1/2017 | |
| WO | WO-2017/015015 A1 | 1/2017 | |
| WO | WO-2017/015101 A1 | 1/2017 | |
| WO | WO-2017/031483 A1 | 2/2017 | |
| WO | WO-2017/040348 A1 | 3/2017 | |
| WO | WO-2017/040511 A1 | 3/2017 | |
| WO | WO-2017/040709 A1 | 3/2017 | |
| WO | WO-2017/048969 A1 | 3/2017 | |
| WO | WO-2017/053729 A1 | 3/2017 | |
| WO | WO-2017/053879 A1 | 3/2017 | |
| WO | WO-2017/062754 A1 | 4/2017 | |
| WO | WO-2017/064546 A1 | 4/2017 | |
| WO | WO-2017/066588 A2 | 4/2017 | |
| WO | WO-2017/070633 A2 | 4/2017 | |
| WO | WO-2017/074962 A1 | 5/2017 | |
| WO | WO-2017/096041 A1 | 6/2017 | |
| WO | WO-2017/099494 A1 | 6/2017 | |
| WO | WO-2017/123609 A1 | 7/2017 | |
| WO | WO-2017/127807 A1 | 7/2017 | |
| WO | WO-2017/129811 A1 | 8/2017 | |
| WO | WO-2017/136335 A1 | 8/2017 | |
| WO | WO-2017/142923 A1 | 8/2017 | |
| WO | WO-2017/147056 A1 | 8/2017 | |
| WO | WO-2017/160752 A1 | 9/2017 | |
| WO | WO-2017/161068 A1 | 9/2017 | |
| WO | WO-2017/165655 A1 | 9/2017 | |
| WO | WO-2017/165826 A1 | 9/2017 | |
| WO | WO-2017/172775 A1 | 10/2017 | |
| WO | WO-2017/180694 A1 | 10/2017 | |
| WO | WO-2017/180711 A1 | 10/2017 | |
| WO | WO-2017/181107 A2 | 10/2017 | |
| WO | WO-2017/184768 A1 | 10/2017 | |
| WO | WO-2017/186550 A1 | 11/2017 | |
| WO | WO-2017/186718 A1 | 11/2017 | |
| WO | WO-2017/189308 A1 | 11/2017 | |
| WO | WO-2017/189336 A1 | 11/2017 | |
| WO | WO-2017/197238 A1 | 11/2017 | |
| WO | WO-2017/201311 A2 | 11/2017 | |
| WO | WO-2017/205650 A1 | 11/2017 | |
| WO | WO-2017/207589 A1 | 12/2017 | |
| WO | WO-2017/212264 A1 | 12/2017 | |
| WO | WO-2017/215648 A1 | 12/2017 | |
| WO | WO-2017/216771 A2 | 12/2017 | |
| WO | WO-2017/219027 A1 | 12/2017 | |
| WO | WO-2017/219033 A1 | 12/2017 | |
| WO | WO-2017/220527 A1 | 12/2017 | |
| WO | WO-2017/222773 A1 | 12/2017 | |
| WO | WO-2018/013840 A1 | 1/2018 | |
| WO | WO-2018/013932 A1 | 1/2018 | |
| WO | WO-2018/015936 A2 | 1/2018 | |
| WO | WO-2018/022634 A1 | 2/2018 | |
| WO | WO-2018/025206 A1 | 2/2018 | |
| WO | WO-2018/030208 A1 | 2/2018 | |
| WO | WO-2018/030457 A1 | 2/2018 | |
| WO | WO-2018/033110 A1 | 2/2018 | |
| WO | WO-2018/035387 A1 | 2/2018 | |
| WO | WO-2018/035388 A1 | 2/2018 | |
| WO | WO-2018/035423 A1 | 2/2018 | |
| WO | WO-2018/049073 A1 | 3/2018 | |
| WO | WO-2018/049077 A1 | 3/2018 | |
| WO | WO-2018/049079 A1 | 3/2018 | |
| WO | WO-2018/049168 A1 | 3/2018 | |
| WO | WO-2018/052247 A1 | 3/2018 | |
| WO | WO-2018/053053 A1 | 3/2018 | |
| WO | WO-2018/064352 A1 | 4/2018 | |
| WO | WO-2018/064371 A1 | 4/2018 | |
| WO | WO-2018/068053 A2 | 4/2018 | |
| WO | WO-2018/069474 A1 | 4/2018 | |
| WO | WO-2018/071663 A1 | 4/2018 | |

(56) References Cited

FOREIGN PATENT DOCUMENTS

| WO | WO-2018/071868 A1 | 4/2018 |
|---|---|---|
| WO | WO-2018/071892 A1 | 4/2018 |
| WO | WO-2018/074979 A1 | 4/2018 |
| WO | WO-2018/081470 A1 | 5/2018 |
| WO | WO-2018/081476 A2 | 5/2018 |
| WO | WO-2018/089437 A1 | 5/2018 |
| WO | WO-2018/089664 A1 | 5/2018 |
| WO | WO-2018/096356 A1 | 5/2018 |
| WO | WO-2018/097257 A1 | 5/2018 |
| WO | WO-2018/098383 A1 | 5/2018 |
| WO | WO-2018/108272 A1 | 6/2018 |
| WO | WO-2018/108338 A1 | 6/2018 |
| WO | WO-2018/108339 A1 | 6/2018 |
| WO | WO-2018/109101 A1 | 6/2018 |
| WO | WO-2018/112451 A1 | 6/2018 |
| WO | WO-2018/119060 A1 | 6/2018 |
| WO | WO-2018/138385 A1 | 8/2018 |
| WO | WO-2018/144546 A1 | 8/2018 |
| WO | WO-2018/149888 A1 | 8/2018 |
| WO | WO-2018/152325 A1 | 8/2018 |
| WO | WO-2018/162702 A1 | 9/2018 |
| WO | WO-2018/170015 A1 | 9/2018 |
| WO | WO-2018/172556 A1 | 9/2018 |
| WO | WO-2018/175872 A1 | 9/2018 |
| WO | WO-2018/188571 A1 | 10/2018 |
| WO | WO-2018/191715 A2 | 10/2018 |
| WO | WO-2018/195313 A1 | 10/2018 |
| WO | WO-2018/195418 A1 | 10/2018 |
| WO | WO-2018/195540 A1 | 10/2018 |
| WO | WO-2018/195545 A2 | 10/2018 |
| WO | WO-2018/195555 A1 | 10/2018 |
| WO | WO-2018/197020 A1 | 11/2018 |
| WO | WO-2018/197495 A1 | 11/2018 |
| WO | WO-2018/209712 A1 | 11/2018 |
| WO | WO-2018/213351 A1 | 11/2018 |

OTHER PUBLICATIONS

Wang et al., Enhancing Targeted Genomic DNA Editing in Chicken Cells Using the CRISPR/Cas9 System. PLoS One. Jan. 9, 2017;12(1):e0169768.

* cited by examiner

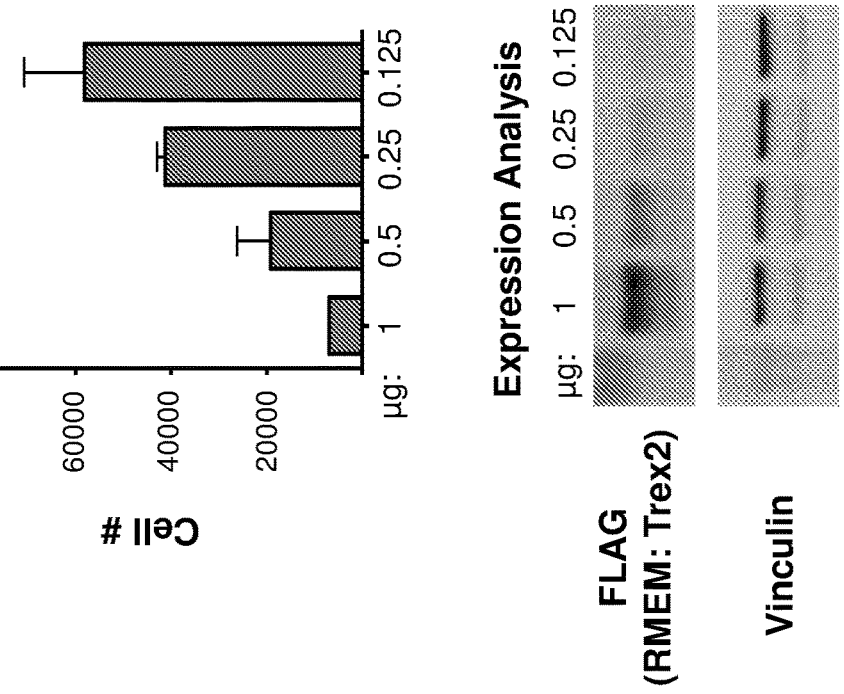
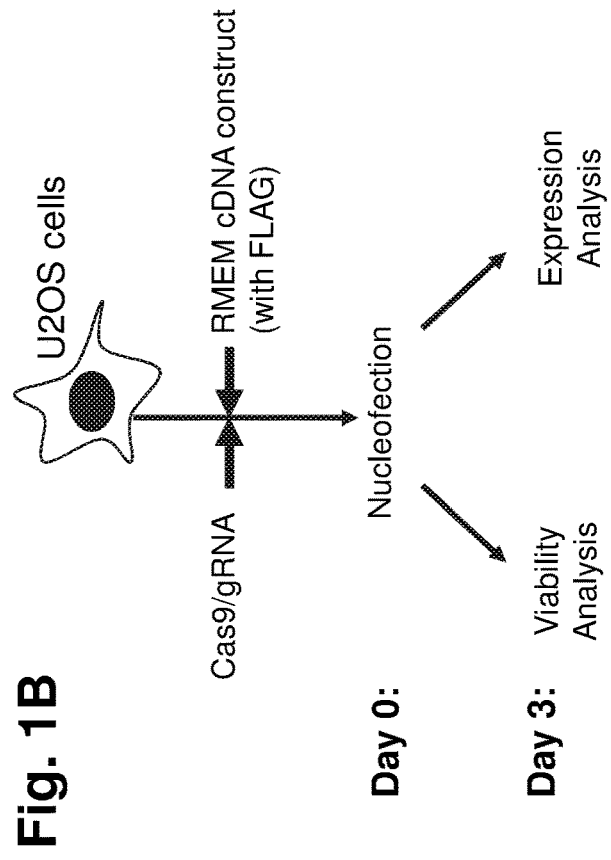
Fig. 1A
Fig. 1B
Fig. 1C

Fig. 2A RMEM cDNA construct
Fig. 2B
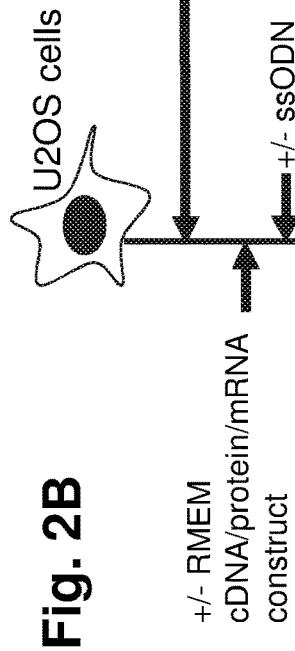

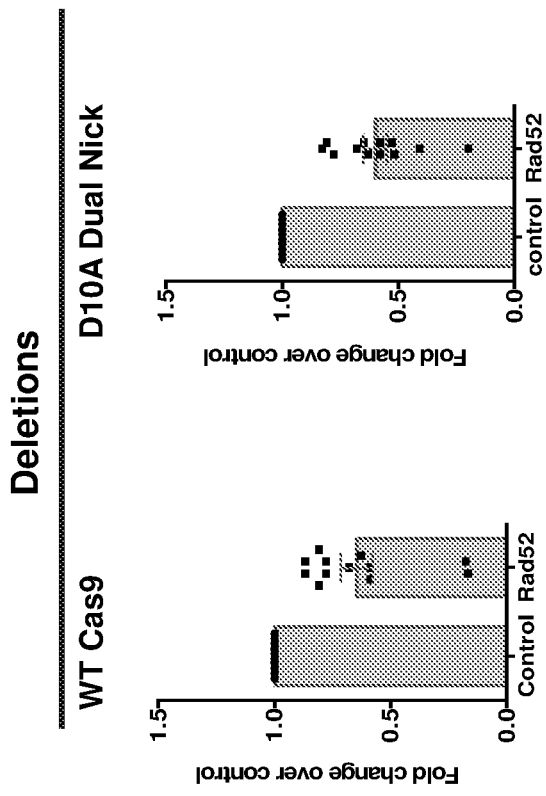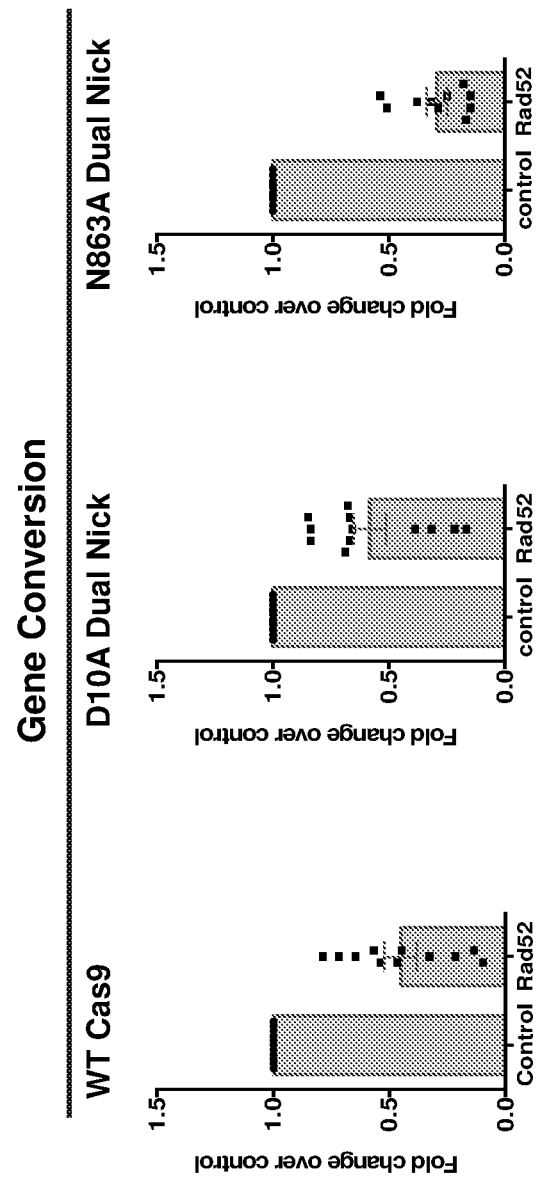
Fig. 3A
Fig. 3B

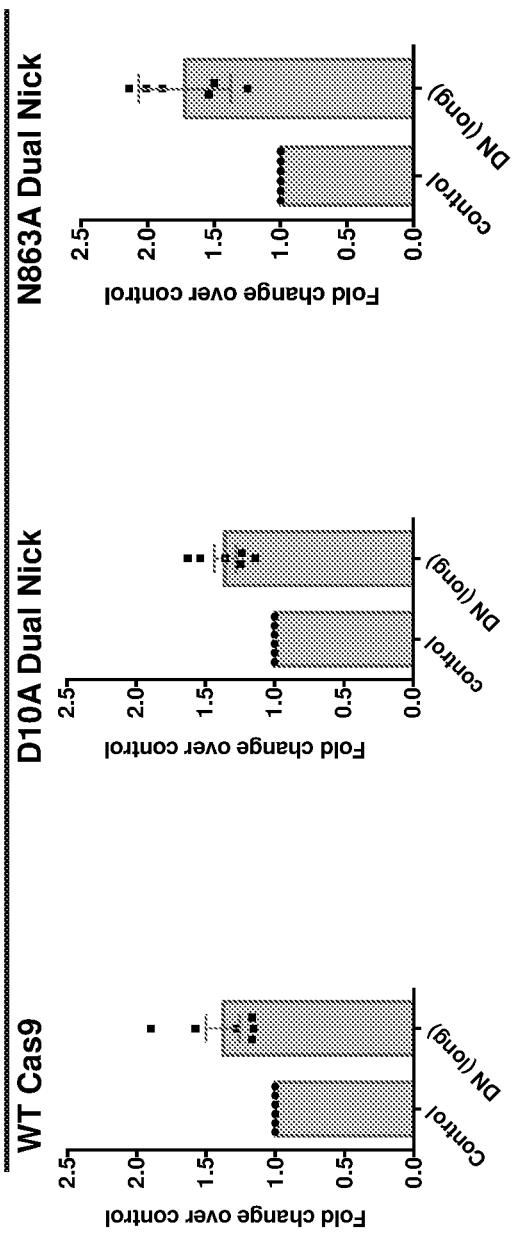

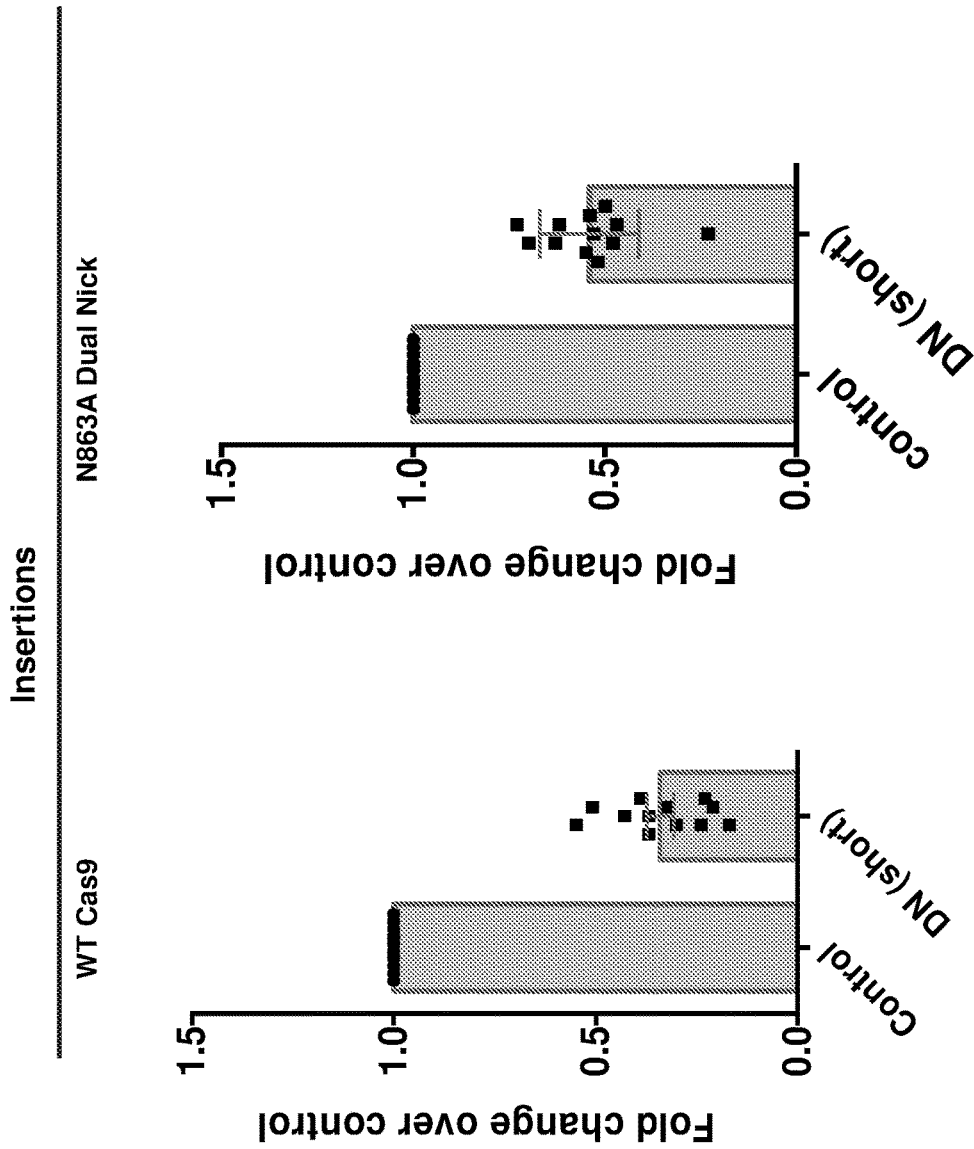

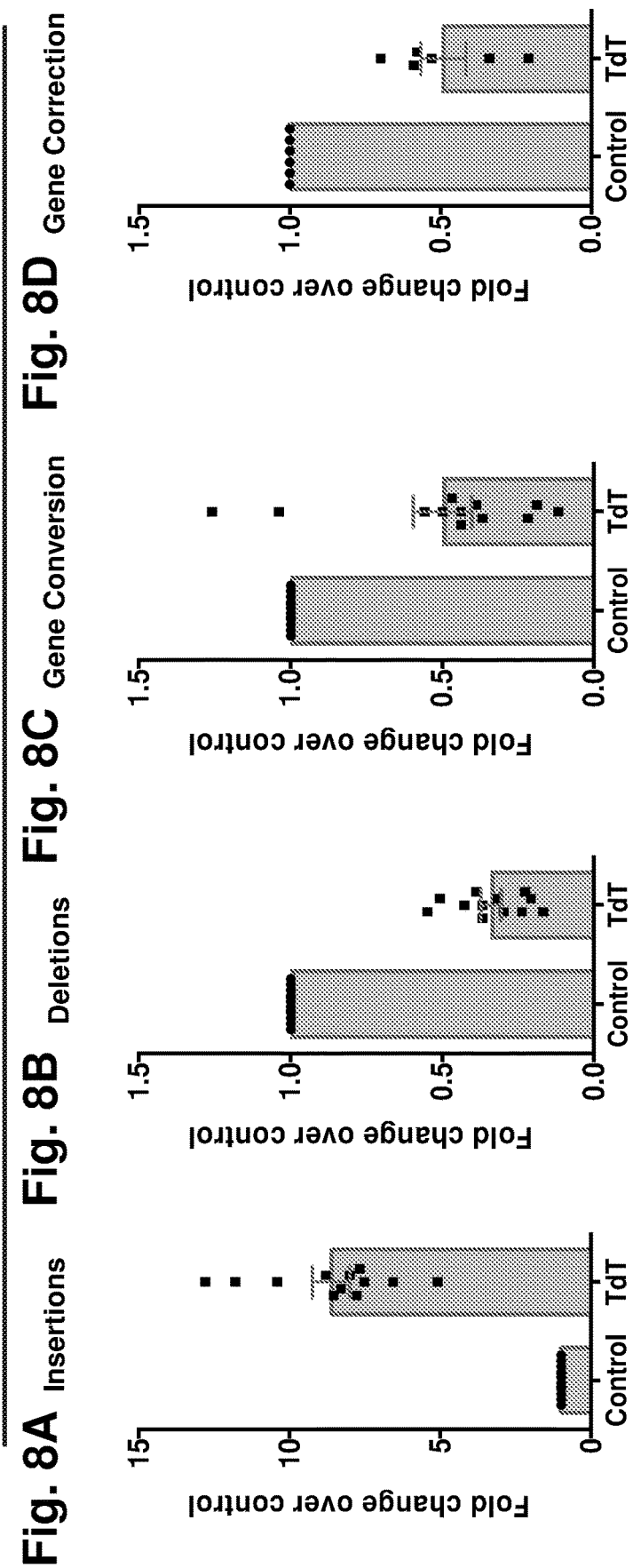

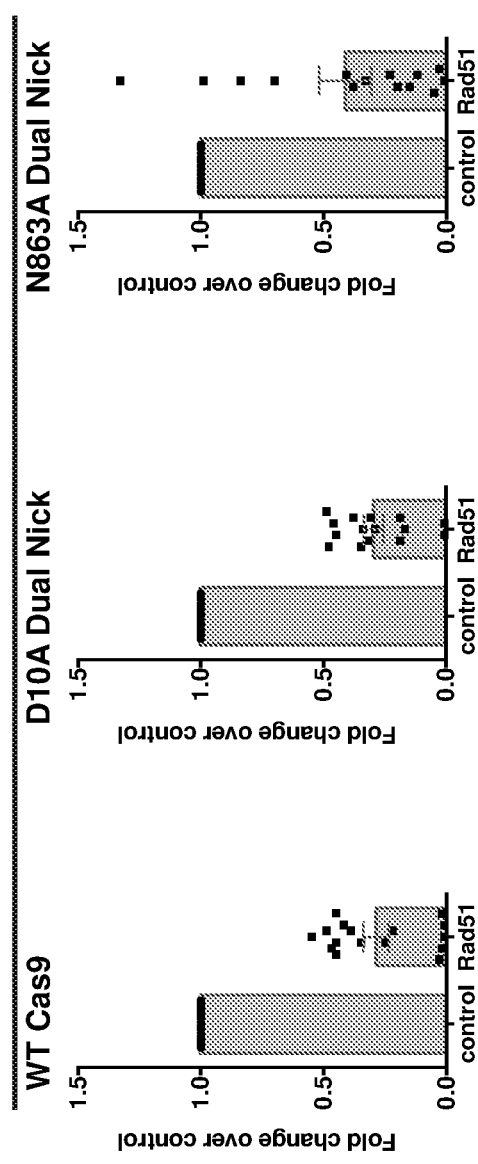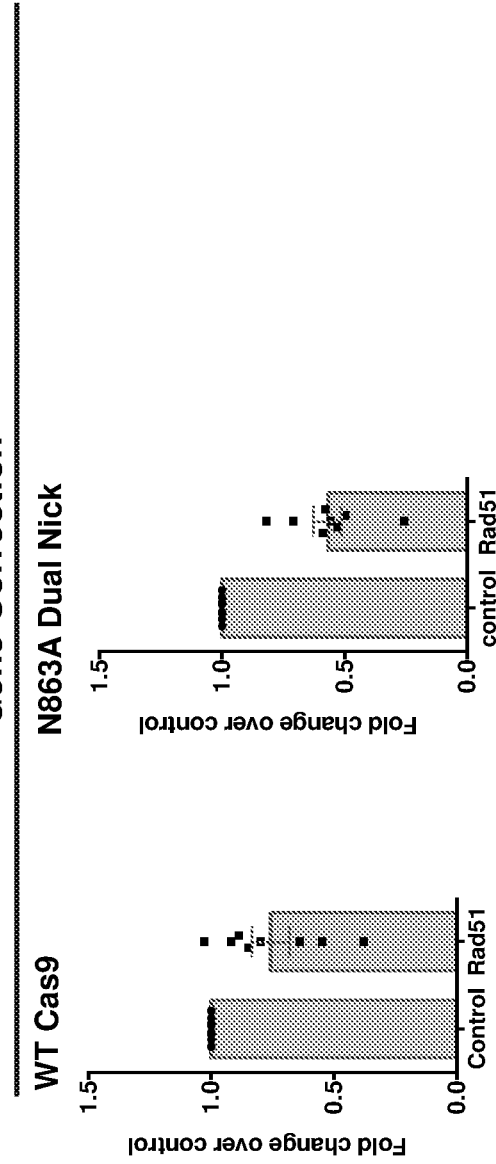
Fig. 9A
Fig. 9B

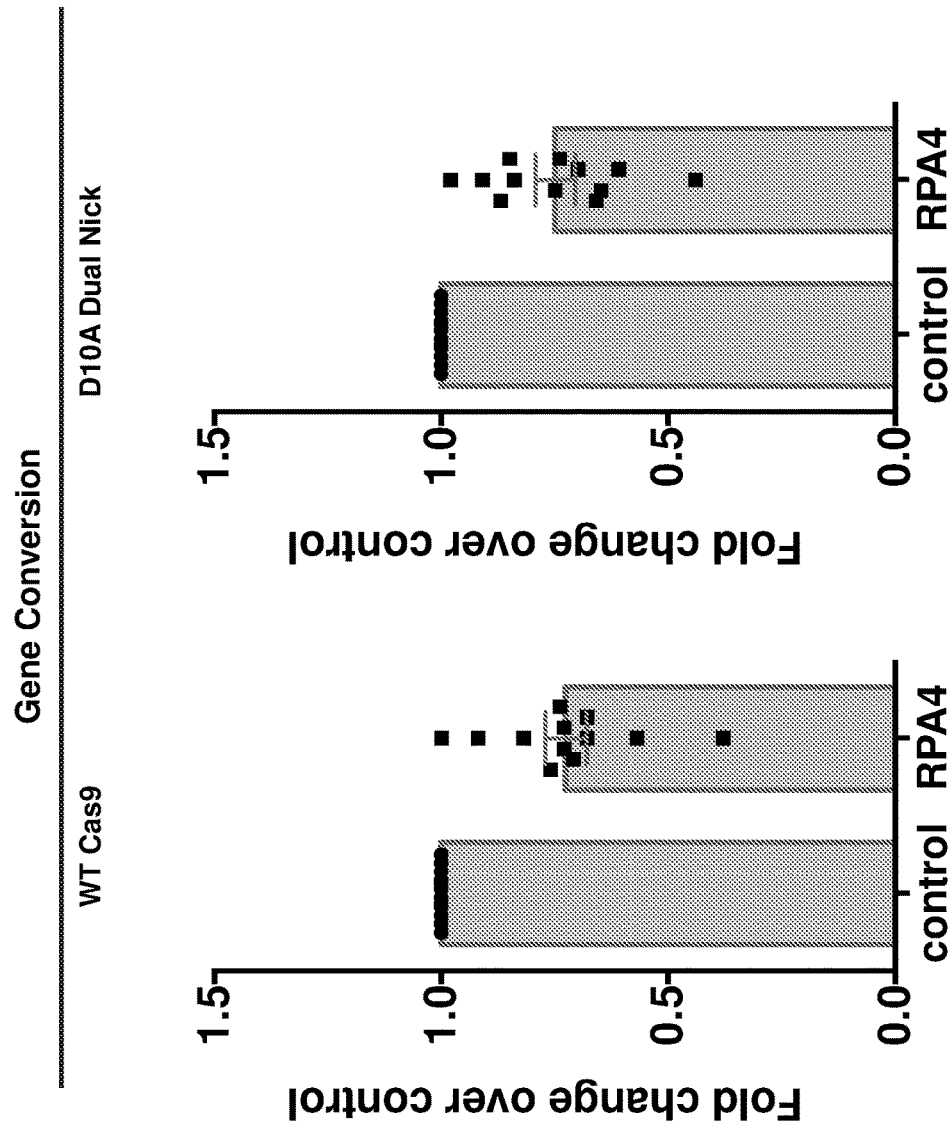

GENOME EDITING SYSTEMS COMPRISING REPAIR-MODULATING ENZYME MOLECULES AND METHODS OF THEIR USE

This application is a 35 U.S.C. § 371 national stage filing of International Application No. PCT/US2017/024110, filed on Mar. 24, 2017, which in turn claims priority to U.S. Provisional Application No. 62/313,247, filed on Mar. 25, 2016. The entire contents of each of the foregoing applications are expressly incorporated herein by reference in their entireties.

SEQUENCE LISTING

The instant application contains a Sequence Listing which has been submitted electronically in ASCII format and is hereby incorporated by reference in its entirety. Said ASCII copy, created on Jun. 6, 2017, is named EM063PCT1_06_06_17_Sequence_Listing.txt and is 727,308 bytes in size.

BACKGROUND

CRISPRs (Clustered Regularly Interspaced Short Palindromic Repeats) evolved in bacteria and archaea as an adaptive immune system to defend against viral attack. Upon exposure to a virus, short segments of viral DNA are integrated into the CRISPR locus. RNA is transcribed from a portion of the CRISPR locus that includes the viral sequence. That RNA, which contains sequence complimentary to the viral genome, mediates targeting of a Cas9 protein to the sequence in the viral genome. The Cas9 protein cleaves and thereby silences the viral target.

Recently, the CRISPR/Cas system has been adapted for genome editing in eukaryotic cells. The introduction of site-specific double strand breaks (DSBs) enables target nucleic acid alteration through endogenous DNA repair mechanisms, such as non-homologous end-joining (NHEJ) or homology-directed repair (HDR). Despite widespread adoption for research use, there remains a need to improve the efficiency of CRISPR/Cas-mediated genome modification to enable its broader application.

SUMMARY

Disclosed herein are components, systems and methods for editing a genome, e.g., by correcting a mutation or disrupting a gene. To edit a genome, an RNA-guided nuclease molecule (e.g., a Cas9 molecule) may be used to mediate a break near a position that one desires to edit. The cell then repairs the break through one of several DNA repair pathways, such as NHEJ or HDR. Provided herein is a genome editing system comprising a RNA-guided nuclease (e.g., a Cas9 molecule), at least one gRNA molecule, and a repair-modulating enzyme molecule (RMEM). It is believed that by contacting a cell, or a population of cells, with a RMEM, the ability of certain cellular DNA repair pathways to resolve or repair a RNA-guided nuclease-mediated cleavage event can be modulated.

Accordingly, in one aspect, the present disclosure provides a method of altering a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM); wherein the gRNA molecule and the RNA-guided nuclease molecule interact with the nucleic acid, resulting in a cleavage event, and wherein the cleavage event is repaired by at least one DNA repair pathway that is modulated by the RMEM, thereby altering the nucleic acid at the target position in the cell, or in the population of cells.

In one aspect, the present disclosure provides a method of suppressing the formation of a deletion in a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is Rad52 or TdT; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM suppresses the formation of a deletion in the nucleic acid at the target position, thereby suppressing the formation of a deletion in the nucleic acid at the target position in the cell, or in the population of cells.

In another aspect, the present disclosure provides a method of enhancing the formation of a deletion in a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is Artemis; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM enhances the formation of a deletion in the nucleic acid at the target position, thereby enhancing the formation of a deletion in the nucleic acid at the target position in the cell, or in the population of cells.

In yet another aspect, the present disclosure provides a method of suppressing gene conversion of a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is Rad52, TdT, Rad51, RPA, or ERCC1; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM suppresses gene conversion, thereby suppressing gene conversion of the nucleic acid at the target position in the cell, or in the population of cells.

In a further aspect, the present disclosure provides a method of enhancing gene conversion of a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM); wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM enhances gene conversion, thereby enhancing gene conversion of the nucleic acid at the target position in the cell, or in the population of cells.

In another aspect, the present disclosure provides a method of suppressing gene correction of a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is TdT, Rad51, or T5 exonuclease; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM suppresses gene correction, thereby suppressing gene correction of the nucleic acid at the target position in the cell, or in the population of cells.

In another aspect, the present disclosure provides a method of enhancing gene correction of a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is Rad52 or 53BP1 dominant negative; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM enhances gene correction, thereby enhancing gene correction of the nucleic acid at the target position in the cell, or in the population of cells.

In yet another aspect, the present disclosure provides a method of suppressing the formation of an insertion in a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is 53BP1 dominant negative or T5 exonuclease; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM suppresses the formation of an insertion, thereby suppressing formation of an insertion in the nucleic acid at the target position in the cell, or in the population of cells.

In a further aspect, the present disclosure provides a method of enhancing the formation of an insertion in a nucleic acid at a target position in a cell, or a population of cells, the method comprising contacting the cell, or the population of cells, with (a) a gRNA molecule; (b) a RNA-guided nuclease molecule; and (c) a heterologous Repair-Modulating Enzyme Molecule (RMEM), wherein the RMEM is TdT; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the RMEM enhances the formation of an insertion, thereby enhancing formation of an insertion in the nucleic acid at the target position in the cell, or in the population of cells.

In some embodiments, the method further comprises contacting the cell, or the population of cells, with (d) a second gRNA molecule, wherein the second gRNA molecule and the RNA-guided nuclease molecule interact with the nucleic acid, resulting in a second cleavage event, and wherein the second cleavage event is repaired by the at least one DNA repair pathway that is modulated by the RMEM. In other embodiments, the RMEM is selected from the group consisting of Rad52, 53BP1 dominant negative, TdT, Rad51, RPA, Artemis, T5 Exonuclease, and ERCC1.

In some embodiments, a frequency of the DNA repair pathway repairing the nucleic acid to comprise a deletion is decreased in the population of cells comprising, exposed to, or contacted with the RMEM, as compared to a frequency of the DNA repair pathway repairing the nucleic acid to comprise a deletion in a population of cells that does not comprise, has not been exposed to, or has not been contacted with the RMEM. In other embodiments, the RMEM is Rad52 or TdT.

In some embodiments, a frequency of the DNA repair pathway repairing the nucleic acid to comprise a deletion is increased in the population of cells comprising, exposed to, or contacted with to the RMEM, as compared to a frequency of the DNA repair pathway repairing the nucleic acid to comprise a deletion in a population of cells that does not comprise, has not been exposed to, or has not been contacted with the RMEM. In other embodiments, the RMEM is Artemis.

In some embodiments, the nucleic acid comprises a deletion after the cleavage event is repaired as compared to the nucleic acid prior to the cleavage event.

In some embodiments, the cleavage event is repaired by gene conversion.

In some embodiments, a frequency of gene conversion is decreased in the population of cells comprising, exposed to, or contacted with the RMEM, as compared to a frequency of gene conversion in a population of cells that does not comprise, has not been exposed to, or has not been contacted with the RMEM. In other embodiments, the RMEM is Rad52, TdT, Rad51, RPA, or ERCC1.

In some embodiments, the cleavage event is repaired by gene correction.

In some embodiments, a frequency of gene correction is decreased in the population of cells comprising, exposed to, or contacted with the RMEM, as compared to a frequency of gene conversion in a population of cells that does not comprise, has not been exposed to, or has not been contacted with the RMEM. In other embodiments, the RMEM is TdT, Rad51, or T5 exonuclease.

In some embodiments, a frequency of gene correction is increased in the population of cells comprising, exposed to, or contacted with the RMEM, as compared to a frequency of gene conversion in a population of cells that does not comprise, has not been exposed to, or has not been contacted with the RMEM. In other embodiments, the RMEM is Rad52 or 53BP1 dominant negative.

In some embodiments, the nucleic acid comprises an insertion after the cleavage event is repaired, as compared to the nucleic acid prior to the cleavage event.

In some embodiments, a frequency of the DNA repair pathway repairing the nucleic acid to comprise an insertion is decreased in the population of cells comprising, exposed to, or contacted with the RMEM, as compared to a frequency of the DNA repair pathway repairing the nucleic acid to comprise an insertion in a population of cells that does not comprise, has not been exposed to, or has not been contacted with the RMEM. In other embodiments, the RMEM is 53BP1 dominant negative or T5 exonuclease.

In some embodiments, a frequency of the DNA repair pathway repairing the nucleic acid to comprise an insertion is increased in the population of cells comprising, exposed to, or contacted with the RMEM, as compared to a frequency of the DNA repair pathway repairing the nucleic acid to comprise an insertion in a population of cells that does not comprise, has not been exposed to, or has not been contacted with the RMEM. In other embodiments, the RMEM is TdT.

In some embodiments, the RMEM is a recombinant protein.

In some embodiments, the gRNA molecule is a gRNA nucleic acid, wherein the RNA-guided nuclease molecule is a RNA-guided nuclease nucleic acid, and wherein the RMEM is a RMEM nucleic acid.

In some embodiments, the gRNA molecule is a gRNA nucleic acid, wherein the RNA-guided nuclease molecule is a RNA-guided nuclease protein, and wherein the RMEM is a RMEM nucleic acid.

In some embodiments, the gRNA molecule is a gRNA nucleic acid, wherein the RNA-guided nuclease molecule is a RNA-guided nuclease nucleic acid, and wherein the RMEM is a RMEM protein.

In some embodiments, the gRNA molecule is a gRNA nucleic acid, wherein the RNA-guided nuclease molecule is a RNA-guided nuclease protein, and wherein the RMEM is a RMEM protein.

In some embodiments, the gRNA is a gRNA nucleic acid, wherein the RNA-guided nuclease molecule is a RNA-guided nuclease protein, and wherein the RMEM is a RMEM protein.

In some embodiments, the cell, or the population of cells, is contacted with the gRNA molecule and the RNA-guided nuclease molecule as a pre-formed complex.

In some embodiments, the RNA-guided nuclease molecule is a Cas9 molecule. In other embodiments, the RNA-guided nuclease molecule comprises at least 80% identity to an *S. aureus* Cas9 sequence or an *S. pyogenes* Cas9 sequence. In another embodiment, the RNA-guided nuclease molecule is an eaCas9 molecule or an eiCas9 molecule. In yet other embodiments, the eaCas9 molecule comprises a nickase molecule. In another embodiment, the Cas9 molecule comprises a mutation at an amino acid position corresponding to amino acid position D10 of *Streptococcus pyogenes* Cas9. In other embodiments, the Cas9 molecule comprises an amino acid mutation at an amino acid position corresponding to amino acid position H840 or N863 of *S. pyogenes* Cas9.

In some embodiments, the gRNA is specific for an HBB gene.

In some embodiments, the method further comprises (e) a third gRNA molecule, wherein the third gRNA molecule and the RNA-guided nuclease molecule interact at the nucleic acid, resulting in a third cleavage event. In other embodiments, the method further comprises (f) a fourth gRNA molecule, wherein the fourth gRNA molecule and the RNA-guided nuclease molecule interact at the nucleic acid, resulting in a fourth cleavage event.

In some embodiments, the cleavage event comprises one or more single strand breaks, one or more double strand breaks, or a combination of single strand breaks and double strand breaks. In other embodiments, the cleavage event comprises any one of the following one single strand break; two single strand breaks; three single strand breaks; four single strand breaks; one double strand break; two double strand breaks; one single strand break and one double strand break; two single strand breaks and one double strand break; or any combination thereof.

In some embodiments, the target position is a control region, a coding region, a non-coding region, an intron, or an exon of a gene.

In some embodiments, the cell, or the population of cells, is a eukaryotic cell, or a population of eukaryotic cells. In other embodiments, the cell, or the population of cells, is a human cell, or a population of human cells.

In some embodiments, the cell, or population of cells, is from a subject suffering from a disease or disorder. In other embodiments, the disease or disorder is a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder cause by aberrant DNA damage repair, or a pain disorder.

In some embodiments, the cell, or population of cells, is from a subject having at least one mutation at the target position.

In some embodiments, the method further comprises isolating the cell, or population of cells, from the subject prior to contacting the cell, or population of cells, with the gRNA molecule, the RNA-guided nuclease molecule, and the RMEM.

In some embodiments, the method further comprises introducing the cell, or the population of cells, into a subject after contacting the cell, or the population of cells, with the gRNA molecule, the RNA-guided nuclease molecule, and the RMEM.

In some embodiments, the contacting the cell, or the population of cells, with the gRNA molecule, the RNA-guided nuclease molecule, and the RMEM is performed ex vivo.

In some embodiments, the contacting the cell, or the population of cells, with the gRNA molecule, the RNA-guided nuclease molecule, and the RMEM is performed in vivo.

In some embodiments, the contacting the cell, or the population of cells, with the gRNA molecule, the RNA-guided nuclease molecule, and the RMEM is performed in vitro.

In some embodiments, the method further comprises sequencing the nucleic acid, or a portion of the nucleic acid, prior to contacting the cell, or the population of cells, with the gRNA molecule, the RNA-guided nuclease molecule, and the RMEM. In other embodiments, the method further comprises sequencing the nucleic acid, or a portion of the nucleic acid, after the cleavage event.

In some embodiments, the sequence of the nucleic acid, after the cleavage event is repaired, is different than the sequence of the nucleic acid prior to the cleavage event.

In one aspect, the present disclosure provides a cell, or a population of cells, altered by the method as described herein.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is Rad52, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid: i) to comprise a deletion is decreased; ii) using gene conversion is decreased; and/or iii) using gene correction is increased in the presence of the RMEM, as compared to a frequency of the DNA repair pathway repairing the target nucleic acid i) to comprise a deletion, ii) using gene conversion, and/or iii) using gene correction in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is 53BP1 dominant negative, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid: i) using gene conversion is increased; ii) using gene correction is increased; and/or iii) to comprise an insertion is decreased in the presence of the RMEM, as compared to a frequency of the DNA repair pathway repairing the target nucleic acid i) using gene conversion, ii) using gene correction, and/or iii) to comprise an insertion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is TdT, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid: i) using gene conversion is decreased; ii) using gene correction is decreased; iii) to comprise an insertion is increased; and/or iv) to comprise a deletion is decreased; in the presence of the RMEM, as compared to a frequency of the DNA repair pathway repairing the target nucleic acid i) using gene conversion, ii) using gene correction, iii) to comprise an insertion, and/or iv) to comprise a deletion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is Rad51, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid: i) using gene conversion is decreased; and/or ii) using gene correction is decreased; in the presence of the RMEM, as compared to a frequency of the DNA repair pathway repairing the target nucleic acid i) using gene conversion and/or ii) using gene correction in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is RPA, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid using gene conversion is decreased in the presence of the RMEM, as compared to a frequency of the DNA repair pathway repairing the target nucleic acid using gene conversion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is Artemis, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid to comprise a deletion is increased in the presence of the RMEM, as compared to a frequency of the DNA repair pathway repairing the target nucleic acid to comprise a deletion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is T5 exonuclease, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid: i) using gene correction is decreased; and/or ii) to comprise an insertion is decreased; in the presence of the RMEM, as compared to a frequency of the DNA repair pathway repairing the target nucleic acid i) using gene correction and/or ii) to comprise an insertion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In one aspect, the present disclosure provides a genome editing system comprising: (a) a gRNA molecule; (b) a RNA-guided nuclease molecule; and (c) a heterologous Repair-Modulating Enzyme Molecule (RMEM), wherein the RMEM is ERCC1, wherein the gRNA molecule and the RNA-guided nuclease molecule are configured to associate with a target nucleic acid, resulting in a cleavage event; wherein the cleavage event is repaired by at least one DNA repair pathway that is modulated by the RMEM; and wherein a frequency of the DNA repair pathway repairing the target nucleic acid using gene conversion is decreased in the presence of the RMEM, as compared to a frequency of the DNA repair pathway repairing the target nucleic acid using gene conversion in the absence of the RMEM. In one embodiment, the frequency of the DNA repair pathway repairing the target nucleic acid is compared to a frequency of the DNA repair pathway repairing the target nucleic acid in the presence of the gRNA molecule and the RNA-guided nuclease molecule, but in the absence of the RMEM.

In some embodiments, the genome editing system further comprises (d) a second gRNA molecule.

In some embodiments, the RMEM is a protein. In other embodiments, the RMEM is a recombinant protein.

In some embodiments, the RMEM is a nucleic acid molecule encoding a RMEM protein. In other embodiments, the nucleic acid molecule is a DNA molecule. In another embodiment, the DNA molecule is a cDNA molecule, a DNA molecule comprising introns, or a codon-optimized DNA. In yet another embodiment, the DNA molecule is located on a plasmid. In other embodiments, the nucleic acid molecule is an RNA molecule. In further embodiments, the RNA molecule is a mRNA molecule.

In some embodiments, the RNA-guided nuclease molecule is a Cas9 molecule. In other embodiments, the Cas9 molecule comprises at least 80% identity to an *S. aureus* Cas9 sequence or an *S. pyogenes* Cas9 sequence. In another embodiment, the Cas9 molecule is an eaCas9 molecule or an eiCas9 molecule. In yet another embodiment, the eaCas9 molecule comprises a nickase molecule. In further embodiments, the Cas9 molecule comprises a mutation at an amino acid position corresponding to amino acid position D10 of *Streptococcus pyogenes* Cas9. In yet another embodiment, the Cas9 molecule comprises an amino acid mutation at an amino acid position corresponding to amino acid position H840 or N863 of *S. pyogenes* Cas9.

In some embodiments, the gRNA is specific for an HBB gene.

In some embodiments, the genome editing system further comprises (e) a third gRNA molecule. In another embodiment, the genome editing system further comprises (f) a fourth gRNA molecule.

In some embodiments, the RNA-guided nuclease molecule is a protein.

In some embodiments, the RNA-guided nuclease molecule is a nucleic acid molecule encoding a RNA-guided nuclease protein. In another embodiment, the nucleic acid molecule is a DNA molecule or an RNA molecule. In yet another embodiment, the DNA molecule is located on a plasmid.

In some embodiments, the gRNA molecule is a gRNA nucleic acid.

In another aspect, the present disclosure provides a cell comprising the genome editing system as described herein.

In another aspect, the present disclosure provides a population of cells, wherein each cell comprises the genome editing system as described herein.

In another aspect, the present disclosure provides a pharmaceutical composition comprising the cell, or the population of cells, as described herein.

In another aspect, the present disclosure provides a method of treating a subject comprising administering to the subject the cell, or the population of cells, as described herein, or the pharmaceutical composition as described herein.

In another aspect, the present disclosure provides a polynucleotide encoding the genome editing system as described herein.

In another aspect, the present disclosure provides a vector encoding the genome editing system as described herein.

In another aspect, the present disclosure provides a genome editing vector system comprising one or more nucleic acids encoding the genome editing system as described herein.

In another aspect, the present disclosure provides a lipid particle comprising the genome editing system as described herein.

In one aspect, the present disclosure provides a method of altering a cell, comprising the steps of: forming, in a deoxyribonucleic acid (DNA) of a cell, at least one single- or double-strand break, thereby exposing at least one single-stranded DNA segment proximate to the single- or double-strand break; and annealing an exogenous single-stranded oligonucleotide donor template to the at least one single-stranded DNA segment, wherein (a) the annealing of the exogenous single-stranded oligonucleotide donor template is facilitated by an exogenous Rad52 protein, and (b) the single- or double-stranded break is repaired in a manner that incorporates at least a portion of a sequence of the exogenous single-stranded oligonucleotide donor template or a reverse complement thereof. In some embodiments, the single- or double-stranded break is repaired in a manner that inhibits incorporation of at least a portion of a sequence of an endogenous donor template or a reverse complement thereof, and/or (d) the single- or double-strand break is repaired in a manner that inhibits deletion of a nucleotide in the DNA.

In one aspect, the present disclosure provides a method of altering a cell, comprising the steps of: forming, in a deoxyribonucleic acid (DNA) of a cell, at least one double-strand break, thereby exposing at least one single-stranded DNA segment proximate to the double-strand break; and annealing an exogenous single-stranded oligonucleotide donor template to the at least one single-stranded DNA segment, wherein (a) the one or more free DNA ends exposed by the double-strand break is facilitated by an exogenous 53BP1 dominant negative protein, and (b) the single- or double-stranded break is repaired in a manner that incorporates at least a portion of a sequence of the exogenous single-stranded oligonucleotide donor template or a reverse complement thereof. In some embodiments, the method further comprises (c) the double-strand break is repaired in a manner that inhibits incorporation of an insertion of at least one nucleotide in the DNA.

In one aspect, the present disclosure provides a method of altering a cell, comprising the steps of: forming, in a deoxyribonucleic acid (DNA) of a cell, at least one single- or double-strand break, thereby generating at least one free 3' end of the DNA; and adding at least one nucleotide to the free 3' end of the DNA at the at least one single- or double-strand break, wherein (a) the single- or double-strand break is repaired in a manner that incorporates the at least one nucleotide added to the 3' end of the DNA strand, and (b) wherein the at least one nucleotide is added by an exogenous terminal deoxynucleotidyl transferase (TdT) protein. In some embodiments, the method further comprises (c) the single- or double-strand break is repaired in a manner that inhibits incorporation of a deletion of at least one nucleotide in the DNA, (d) the single- or double-stranded break is repaired in a manner that inhibits incorporation of at least a portion of a sequence of an endogenous donor template or a reverse complement thereof, and (e) the single- or double-stranded break is repaired in a manner that inhibits incorporation of at least a portion of a sequence of an exogenous single-stranded oligonucleotide donor template or a reverse complement thereof.

In one aspect, the present disclosure provides a method of altering a cell, comprising the steps of: forming, in a deoxyribonucleic acid (DNA) of a cell, at least one single- or double-strand break, thereby generating at least one free 5' end of the DNA; and removing at least one nucleotide from the free 5' end of the DNA at the at least one single- or double-strand break, wherein (a) the single- or double-strand break is repaired in a manner that deletes the at least one nucleotide from the 5' end of the DNA strand, and (b) wherein the at least one nucleotide is deleted by an exogenous Artemis protein.

In one aspect, the present disclosure provides a method of altering a cell, comprising the steps of: forming, in a deoxyribonucleic acid (DNA) of a cell, at least one single- or double-strand break, thereby generating a 3' single-stranded overhang and/or a 5' single-stranded overhang in the DNA; and cleaving a phosphodiester backbone of the DNA to remove at least a portion of the 3' single-stranded overhang and/or the 5' single-stranded overhang, wherein (a) the phosphodiester backbone of the DNA is cleaved by an exogenous ERCC1 protein, and (b) wherein the single- or double-stranded break is repaired in a manner that inhibits incorporation of at least a portion of a sequence of an exogenous single-stranded oligonucleotide donor template, or reverse complement thereof.

In some embodiments, the method further comprises the step of forming the at least one single- and/or double-strand break comprises administering to the cell an RNA-guided nuclease, optionally a Class 2 Clustered Regularly Interspersed Repeat (CRISPR)-associated nuclease. In other embodiments, the RNA-guided nuclease is selected from the group consisting of a wild-type Cas9, a Cas9 nickase, a wild-type Cpf1, and a Cpf1 nickase. In another embodiment, administering the RNA-guided nuclease to the cell comprises introducing into the cell a ribonucleoprotein (RNP) complex comprising an RNA-guided nuclease and a guide RNA. In yet another embodiment, the step of forming the at least one single- and/or double-strand break further comprises introducing a single-stranded oligonucleotide donor template into the cell, with the RNP complex, and the protein. In yet further embodiments, the step of administering the RNA-guided nuclease to the cell comprises electroporation of the cell in the presence of the RNP complex, thereby introducing the RNP complex into the cell.

Where applicable or not specifically disclaimed, any one of the embodiments described herein are contemplated to be able to combine with any other one or more embodiments, even though the embodiments are described under different aspects of the disclosure.

These and other embodiments are disclosed or are obvious from and encompassed by, the following Detailed Description.

BRIEF DESCRIPTION OF THE DRAWINGS

The accompanying drawings are intended to provide illustrative, and schematic rather than comprehensive, examples of certain aspects and embodiments of the present disclosure. The drawings are not intended to be limiting or binding to any particular theory or model, and are not necessarily to scale. Without limiting the foregoing, nucleic acids and polypeptides may be depicted as linear sequences, or as schematic two- or three-dimensional structures; these depictions are intended to be illustrative rather than limiting or binding to any particular model or theory regarding their structure.

FIG. 1A shows schematics of the RMEM cDNA expression construct used for viability and expression optimization experiments. The RMEM is fused to a nuclear localization signal at the N-terminus and contains a C-terminal 3×FLAG tag.

FIG. 1B shows a schematic of the experimental set-up for expression/viability analysis: U2OS cells were nucleofected with Cas9/gRNA and the RMEM cDNA construct. On day 3, cells were collected for viability analysis and protein expression analysis.

FIG. 1C shows (in the upper panel) a viability analysis for the RMEM Trex2 at the indicated concentrations. The lower panel shows a Western Blot using FLAG to assess expression of the RMEM Trex2 at the indicated concentrations.

FIG. 2A shows schematics of the RMEM cDNA expression used for experiments to determine effect of RMEM on repair pathway choice/outcome. The RMEM is fused to a nuclear localization signal at the N-terminus.

FIG. 2B shows a schematic of the experimental set-up for RMEM screen: U2OS cells were nucleofected on day 0 with a Cas9/gRNA variant, the RMEM cDNA construct and a ssODN. On day 5, cells were collected, lysed, and gDNA was extracted. A locus PCR for the HBB locus performed and PCR products were subjected to high throughput sequencing using an Illumina MiSeq sequencer and computationally analysed for the occurrence of repair events. The RMEM can be delivered as DNA (e.g., cDNA, DNA containing introns, or codon optimized DNA), protein and/ or mRNA.

FIG. 3A shows the cDNA expression of Rad52 represses the formation of deletions in the context of a WT Cas9-induced DSB and D10A-induced dual nick lesions using gRNAs HBB8 and HBB 15.

FIG. 3B demonstrates the cDNA expression of Rad52 represses gene conversion in the context of a WT Cas9-induced DSB, D10A-induced dual nick lesions and N863A-induced dual nick lesions with gRNAs HBB8 and HBB 15.

FIG. 6A shows the cDNA expression of 53BP1 Dominant Negative (DN)—long enhances gene correction in the context of a WT Cas9-induced DSB, D10A-induced dual nick lesions and N863A-induced dual nick lesions with gRNAs HBB8 and HBB 15.

FIG. 6B shows the cDNA expression of 53BP1 Dominant Negative (DN)—short enhances gene correction in the context of a WT Cas9-induced DSB and N863A-induced dual nick lesions with gRNAs HBB8 and HBB15.

FIG. 7 shows the cDNA expression of 53BP1 Dominant Negative (DN)—short represses the formation of insertions in the context of a WT Cas9-induced DSB with gRNA Hbb8 and N863A-induced dual nick lesions with gRNAs HBB8 and HBB 15.

FIG. 8A shows the cDNA expression of TdT enhances the formation of insertions in the context of a WT Cas9-induced DSB with gRNA HBB8.

FIG. 8B shows the cDNA expression of TdT represses the formation of deletions in the context of a WT Cas9-induced DSB with gRNA HBB8.

FIG. 8C shows the cDNA expression of TdT represses gene conversion in the context of a WT Cas9-induced DSB with gRNA HBB8.

FIG. 8D shows the cDNA expression of TdT represses gene correction in the context of a WT Cas9-induced DSB with gRNA HBB8.

FIG. 9A shows the cDNA expression of Rad51 represses gene conversion in the context of a WT Cas9-induced DSB, D10A-induced dual nick lesions and N863A-induced dual nick lesions with gRNAs HBB8 and HBB15.

FIG. 9B shows the cDNA expression of Rad51 represses gene correction in the context of a WT Cas9-induced DSB, D10A-induced dual nick lesions and N863A-induced dual nick lesions with gRNAs HBB8 and HBB15.

FIG. 10 shows the cDNA expression of RPA represses the formation of insertions in the context of a WT Cas9-induced DSB and D10A-induced dual nick lesions with gRNAs HBB8 and HBB15.

DETAILED DESCRIPTION

Definitions

Figure 4A:
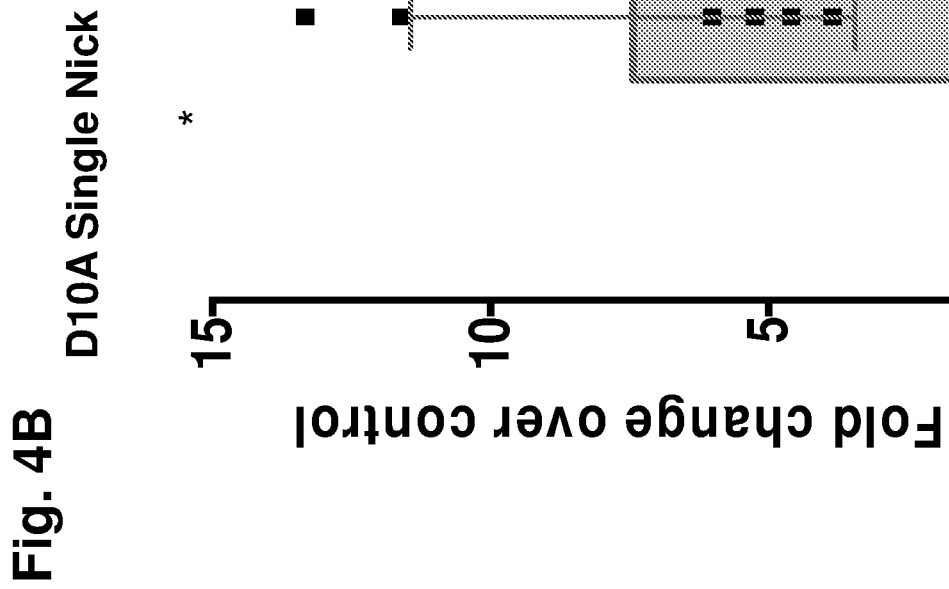
FIG. 4A shows the cDNA expression of Rad52 enhances gene correction in the context of a D10A dual nick lesion induced by D10A Cas9 with gRNAs HBB8 and HBB 15 (dual nick—5' overhang).

Unless otherwise specified, each of the following terms has the meaning associated with it in this section.

The indefinite articles "a" and "an" refer to at least one of the associated noun, and are used interchangeably with the terms "at least one" and "one or more." For example, "a module" means at least one module, or one or more modules.

The conjunctions "or" and "and/or" are used interchangeably as non-exclusive disjunctions.

"Alter", "altered", or "altering", as the term is used herein, in reference to amino acid or nucleotide sequences, refers to a change in a sequence, e.g., a deletion of one or more amino acid residues or nucleotides, a mutation of one or more amino acid residues or nucleotides, or an insertion of one or more amino acid residues or nucleotides.

"Amino acids" as used herein encompasses the canonical amino acids as well as analogs thereof.

"Amino acid residues that flank a deletion", as that phrase is used herein, refers to the amino acid residue that immediately precedes the deletion and the amino acid residue that immediately follows the deletion. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the amino acid residues that flank the deletion are, $_{CT}3$ and $_{CT}7$.

An "indel" is an insertion and/or deletion in a nucleic acid sequence. An indel may be the product of the repair of a DNA double strand break, such as a double strand break formed by a genome editing system of the present disclosure. An indel is most commonly formed when a break is repaired by an "error prone" repair pathway such as the NHEJ pathway described below. "Gene conversion" refers to the alteration of a DNA sequence by incorporation of an endogenous homologous sequence (e.g., a homologous sequence within a gene array). "Gene correction" refers to the alteration of a DNA sequence by incorporation of an exogenous homologous sequence, such as an exogenous single- or double stranded donor template DNA. Gene conversion and gene correction are products of the repair of DNA double-strand breaks by HDR pathways such as those described below.

Indels, gene conversion, gene correction, and other genome editing outcomes are typically assessed by sequencing (most commonly by "next-gen" or "sequencing-by-synthesis" methods, though Sanger sequencing may still be used) and are quantified by the relative frequency of numerical changes (e.g., ±1, ±2 or more bases) at a site of interest among all sequencing reads. DNA samples for sequencing may be prepared by a variety of methods known in the art, and may involve the amplification of sites of interest by polymerase chain reaction (PCR), the capture of DNA ends generated by double strand breaks, as in the GUIDEseq process described in Tsai et al. (Nat. Biotechnol. 34(5): 483 (2016), incorporated by reference herein) or by other means well known in the art. Genome editing outcomes may also be assessed by in situ hybridization methods such as the FiberComb™ system commercialized by Genomic Vision (Bagneux, France), and by any other suitable methods known in the art.

"RNA-guided nucleases" according to the present disclosure include, but are not limited to, naturally-occurring Class 2 CRISPR nucleases such as Cas9, and Cpf1, as well as other nucleases derived or obtained therefrom. In functional terms, RNA-guided nucleases are defined as those nucleases that: (a) interact with (e.g., complex with) a gRNA; and (b) together with the gRNA, associate with, and optionally cleave or modify, a target region of a DNA that includes (i) a sequence complementary to the targeting domain of the gRNA and, optionally, (ii) an additional sequence referred to as a "protospacer adjacent motif," or "PAM," which is described in greater detail below. As the following examples will illustrate, RNA-guided nucleases can be defined, in broad terms, by their PAM specificity and cleavage activity, even though variations may exist between individual RNA-guided nucleases that share the same PAM specificity or cleavage activity. Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the term RNA-guided nuclease should be understood as a generic term, and not limited to any particular type (e.g. Cas9 vs. Cpf1), species (e.g. S. pyogenes vs. S. aureus) or variation (e.g., full-length vs. truncated or split; naturally-occurring PAM specificity vs. engineered PAM specificity, etc.) of RNA-guided nuclease.

"Cas9 molecule," as that term is used herein, refers to a "Cas9 polypeptide" or a nucleic acid encoding a Cas9 polypeptide. A "Cas9 polypeptide" is a polypeptide that can bind (1) a PAM (a protospacer adjacent motif) in a nucleic acid and (2) a guide RNA (gRNA) molecule. In one embodiment, in concert with the gRNA molecule, a Cas9 polypeptide can localize to a site which comprises a target domain.

A Cas9 molecule may be a nuclease (an enzyme that cleaves both strands of a double-stranded nucleic acid), a nickase (an enzyme that cleaves one strand of a double-stranded nucleic acid), or an enzymatically inactive (or dead) Cas9 molecule. A Cas9 molecule having nuclease or nickase activity is referred to as an enzymatically active Cas9 molecule (an eaCas9 molecule). A Cas9 molecule lacking the ability to cleave target nucleic acid is referred to as an "enzymatically inactive Cas9 molecule" (an "eiCas9 molecule"). A Cas9 molecule can have the amino acid sequence of a naturally occurring Cas9 molecule or can be an altered, engineered or modified Cas9 molecule, which differs by at least one amino acid residue, from a reference sequence, e.g., the most similar naturally occurring Cas9 molecule. (The terms altered, engineered or modified, as used in this context, refers merely to a difference from a reference or naturally occurring sequence, and impose no specific process or origin limitations). A Cas9 molecule may be a Cas9 polypeptide or a nucleic acid encoding a Cas9 polypeptide.

In one embodiment, a Cas9 molecule meets one or both of the following criteria:

it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule.

In one embodiment, the Cas9 molecule may be a Cas9 deletion, e.g., the Cas9 may comprise a deletion in one or more of the following domains: a REC2, REC1$_{CT}$, or REC1$_{SUB}$ domain, and optionally, a linker disposed between the amino acids flanking the deletion. Except for any REC deletion and associated linker, a Cas9 molecule meets one or both of the following criteria:

it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas 9 molecule. Homology except for any REC deletion is determined as follows: a sequence having a deletion is altered by replacing the deleted sequence with the corresponding sequence from the reference sequence, and the altered sequence is compared with the reference sequence.

In another embodiment, the Cas9 molecule may be a Cas9 variant, e.g., the Cas9 may comprise an altered PI domain, or other modified amino acid sequence, or the Cas9 may comprise a linker. In an alternate embodiment, except for an altered PI domain or other modified amino acid sequence, a Cas9 molecule meets one or both of the following criteria:

it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas 9 molecule. Homology except for an altered PI domain, or other modified amino acid sequence is determined as follows: a sequence having an altered PI domain (or other modified amino acid sequence) is altered by restoring the altered PI domain (or other modified amino acid sequence) to the naturally occurring PI domain (or other naturally occurring sequence) from the reference sequence, and the thus altered sequence is compared with the reference sequence.

In an alternate embodiment, except for a linker, a Cas9 molecule meets one or both of the following criteria:

it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas 9 molecule. Homology except for a linker is determined as follows: a sequence having a linker is altered by omitting the linker sequence, and the thus altered sequence is compared with the reference sequence.

In another embodiment, each domain of the Cas9 molecule, including any remaining portion of a REC2, REC1$_{CT}$, or REC1$_{SUB}$ domain having a deletion or an unaltered portion of a PI domain, will, independently have: at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with such a domain described herein. In one embodiment at least 1, 2, 3, 4, 5, of 6 domains will have, independently, at least 50, 60, 70, 80, 81, 82, 83, 84, 85, 86, 87, 88, 89, 90, 91, 92, 93, 94, 95, 96, 97, 98, 99, or 100% homology with a corresponding domain, while any remaining domains will be absent, or have less homology to their corresponding naturally occurring domains.

In one embodiment, the Cas9 molecule is a *S. pyogenes* Cas9 variant. In certain embodiments, the Cas9 variant is the EQR variant. In certain embodiments, the Cas9 variant is the VRER variant. In certain embodiments, the eiCas9 molecule is a *S. pyogenes* Cas9 variant. In certain embodiments, the Cas9 variant is the EQR variant. In certain embodiments, the Cas9 variant is the VRER variant. In some embodiments the *S. pyogenes* Cas9 variant comprises an alanine substitution at a positively charged residue (see Slaymaker et al. (2015) "Rationally engineered Cas9 nucleases with improved specificity," SCIENCE (Published online Dec. 1, 2015) [DOI: 10.1126/science.aad5227]). In some embodiments the *S. pyogenes* Cas9 variant comprises one or more of the following mutations: R780A, K810A, K848A, K855A, H982A, R976A, R1003A, and R1060A (see Slaymaker et al.). In some embodiments the *S. pyogenes* Cas9 variant comprises one or more mutations in the following amino acid residues: R780, K810, K848, K855, H982, R976, R1003, and R1060. In some embodiments, the *S. pyogenes* Cas9 variant is the K855A variant (see Slaymaker et al.). In some embodiments, the *S. pyogenes* Cas9 variant is the K810A/K1003A/R1060A variant (also known as "eSpCas9 (1.0)") (see Slaymaker et al.). In some embodiments, the *S.*

*pyogenes* Cas9 variant is the K848A/K1003A/R1060A variant (also known as "eSpCas9(1.1)") (see Slaymaker et al.).

In some embodiments, the Cas9 molecule is a *S. aureus* Cas9 variant. In certain embodiments, the Cas9 variant is the KKH (E782K/N968K/R1015H) variant (see Kleinstiver et al. (2015) NAT. BIOTECHNOL. doi: 10.1038/nbt.3404, the entire contents of which are expressly incorporated herein by reference). In some embodiments, the Cas9 variant is the E782K/K929R/R1015H variant (see Kleinstiver et al. (2015)). In some embodiments, the Cas9 variant is the E782K/K929R/N968K/R1015H variant (see Kleinstiver et al. (2015). In some embodiments the Cas9 variant comprises one or more mutations in one of the following amino acid residues: E782, K929, N968, R1015. In some embodiments the Cas9 variant comprises one or more of the following mutations: E782K, K929R, N968K, R1015H and R1015Q (see Kleinstiver et al. (2015)).

"Cas9 polypeptide", as that term is used herein, also refers to a Cas9 molecule having at least 80, 81, 82, 83, 84, 85, 86, 87, 88, 89, 90, 91, 92, 93, 94, 95, 96, 97, 98, 99, or 100% homology with a reference Cas9 molecule. A Cas9 polypeptide can be enzymatically active (an eaCas9 polypeptide), or can lack the ability to cleave a target nucleic acid (an eiCas9 polypeptide).

"Cas9 core domain", as that term is used herein, refers to a polypeptide that does not include a functional PI domain, e.g., a polypeptide not having an endogenous PI domain, e.g., wherein the endogenous PI domain is deleted (deleted, as used in this context, refers merely to a sequence difference or the absence of amino acid residues and implies no process or origin limitation), or generally, a Cas9 molecule lacking a PI domain. In one embodiment, a Cas9 core domain comprises a REC1 domain, a REC2 domain, a BH domain, a RuvC domain, and an HNH domain. A Cas9 core domain, together with an altered PI domain, comprises a functional Cas9 molecule.

In one embodiment, a species X Cas9 core domain has at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain. In one embodiment, each of a REC1 domain, a REC2 domain, a BH domain, a RuvC domain, and/or an HNH domain of a species X Cas9 core domain has, independently, at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain.

"Cleavage event", as used herein, is intended to include Cas9-mediated single-stranded and double-stranded DNA breaks. In one embodiment, the term "cleavage event" refers to one or more Cas9-mediated single-stranded DNA breaks. In one embodiment, the term "cleavage event" refers to one or more Cas9-mediated double-stranded DNA breaks. In one embodiment, the term "cleavage event" refers to a combination of one or more Cas9-mediated single-stranded DNA breaks, and one or more Cas9-mediated double-stranded DNA breaks.

"Contacting", as used herein in reference to a cell or a population of cells, is intended to include indirect or direct bringing together of a compound, e.g., a polypeptide or a nucleic acid, and a cell, or a population of cells. The term "contacting", as used herein, does not imply or require that the compound enter and/or traverse a membrane and/or cell wall of a cell, or a population of cells. However, in some embodiments, a compound may enter and/or traverse a membrane and/or cell wall of a cell, or a population of cells, after it is "contacted" with the compound. In some embodiments, the term "contacting" is intended to include in vitro exposure of a cell, or a population of cells, to a compound. In some embodiments, the term "contacting" is intended to include in vivo exposure of a cell, or a population of cells, to a compound. In some embodiments, the term "contacting" is intended to include ex vivo exposure of a cell, or a population of cells, to a compound. In some embodiments, the term "contacting" is intended to include exposure of a compound to a cell, or a population of cells via a carrier, e.g., a liposome or a viral particle. In some embodiments, the term "contacting" is intended to include exposure of a cell, or a population of cells, to a nucleic acid molecule, e.g., a DNA molecule, or a RNA molecule (e.g., a miRNA molecule or a gRNA molecule). In some embodiments, the term "contacting" is intended to include exposure of a cell, or a population of cells, to a polypeptide.

"Derived from", as used herein, refers to the source or origin of a molecular entity, e.g., a nucleic acid or protein. The source of a molecular entity may be naturally-occurring, recombinant, unpurified, or a purified molecular entity. For example, a polypeptide that is derived from a second polypeptide comprises an amino acid sequence that is identical or substantially similar, e.g., is more than 50% homologous to, the amino acid sequence of the second protein. The derived molecular entity, e.g., a nucleic acid or protein, can comprise one or more modifications, e.g., one or more amino acid or nucleotide changes.

"Frequency", as that term is used herein, refers to the rate at which a certain event occurs, or is likely to occur, in a population, e.g., a population of cells. For example, as used herein, an increase (i.e., enhancement) or decrease (i.e., suppression) in a frequency may refer to an increase, or decrease, respectively, of a particular event occurring in a given sample, relative to an untreated, control sample (e.g., an untreated control cell or control population of cells). As used herein, the term "frequency of DNA repair" in a sample refers to the frequency with which DNA is repaired in a sample, e.g., the frequency with which DNA is repaired in a sample as compared to a control sample. As an example, a frequency of DNA repair may be increased or decreased in a population of cells exposed to an RMEM and a genome editing system, e.g., comprising a RNA-guided nuclease and a gRNA, as compared to a frequency of DNA repair in a population of cells that has been exposed to the genome editing system but not the RMEM. In some embodiments, the control can be a sample which has been exposed to a genome editing system but not an RMEM. In another embodiments, the control can be a sample which has not been exposed to an RMEM.

In some embodiments, the frequency with which DNA is repaired in a sample, e.g., population of cells, is increased, e.g., increased by about 5%, 10%, 15%, 20%, 25%, 30%, 35%, 40%, 45%, 50%, 55%, 60%, 65%, 70%, 75%, 80%, 85%, 90%, 95%, 1-fold, 1.5-fold, 2-fold, 2.5-fold, 3-fold, 3.5-fold, 4-fold, 4.5-fold, 5-fold, 5.5-fold, 6-fold, 6.5-fold, 7-fold, 7.5-fold, 8-fold, 8.5-fold, 9-fold, 9.5-fold, 10-fold, 10.5-fold, 11-fold, 11.5-fold, 12-fold, 12.5-fold, 13-fold, 13.5-fold, 14-fold, 14.5-fold, 15-fold, 16-fold, 17-fold, 18-fold, 19-fold, or by about 20-fold, as compared to a control sample, e.g., a control population of cells. In another embodiment, the frequency with which DNA is repaired in a sample, e.g., population of cells, is decreased, e.g., decreased by about 5%, 10%, 15%, 20%, 25%, 30%, 35%, 40%, 45%, 50%, 55%, 60%, 65%, 70%, 75%, 80%, 85%, 90%, 95%, 1-fold, 1.5-fold, 2-fold, 2.5-fold, 3-fold, 3.5-fold, 4-fold, 4.5-fold, 5-fold, 5.5-fold, 6-fold, 6.5-fold, 7-fold, 7.5-fold, 8-fold, 8.5-fold, 9-fold, 9.5-fold, 10-fold, 10.5-fold, 11-fold, 11.5-fold, 12-fold, 12.5-fold, 13-fold, 13.5-fold, 14-fold, 14.5-fold, 15-fold, 16-fold, 17-fold, 18-fold, 19-fold, or by about 20-fold, as compared to a control sample, e.g., a control population of cells.

"PI domain", as that term is used herein, refers to the region of a Cas9 molecule that interacts with the PAM sequence of a target nucleic acid.

"Altered PI domain", as that term is used herein, refers to a PI domain other than the native or endogenous PI domain associated with the naturally occurring Cas9 molecule. For example, a Cas9 molecule comprises an altered PI domain if its PI domain is other than the PI domain naturally associated with the Cas9 core domain of the Cas9 molecule, or if its PI domain is not a naturally occurring PI domain associated with any Cas9 molecule. (Derived, as used in this sense, is not limited to physical derivation or even derivation from a specific source, and does not require a process limitation, but In one embodiment, includes mere structural similarity). An altered PI domain may have less than 99, 98, 97, 96, 95, 94, 93, 92, 91, 90, 89, 88, 87, 86, 85, 84, 83, 82, 81, 80, 70, 60, 50, 30, 40, 30, 20, or 10% homology with the native or endogenous PI domain of a subject naturally occurring Cas9 molecule from which the Cas9 core domain is derived. An altered PI domain may have a different PAM recognition sequence, also referred to as the RKR motif, than that of the native or endogenous PI domain of the Cas9 species that supplies the Cas9 core domain. The RKR motif of an altered PI domain may differ from the RKR motif of the native or endogenous PI domain of the Cas9 core domain by 1, 2, or 3 residues. The RKR motif of the altered PI differs at the first position, the second position, the third position, the first and second positions, the first and third positions, the second and third positions, or all three positions, from the RKR motif of the PI endogenous to or naturally associated with the Cas9 core domain. In one embodiment, an altered PI domain is one having greater homology with the PI domain of a reference or donor naturally occurring Cas9 molecule (a heterologous Cas9) that with the native PI domain of a subject Cas9.

The terms "homology" or "identity," as used interchangeably herein, refer to sequence identity between two amino acid sequences or two nucleic acid sequences, with identity being a more strict comparison. The phrases "percent identity or homology" and "% identity or homology" refer to the percentage of sequence identity found in a comparison of two or more amino acid sequences or nucleic acid sequences. Two or more sequences can be anywhere from 0-100% identical, or any value there between. Identity can be determined by comparing a position in each sequence that can be aligned for purposes of comparison to a reference sequence. When a position in the compared sequence is occupied by the same nucleotide base or amino acid, then the molecules are identical at that position. A degree of identity of amino acid sequences is a function of the number of identical amino acids at positions shared by the amino acid sequences. A degree of identity between nucleic acid sequences is a function of the number of identical or matching nucleotides at positions shared by the nucleic acid sequences. A degree of homology of amino acid sequences is a function of the number of amino acids at positions shared by the polypeptide sequences.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

As used herein, the terms "heterologous", "heterologous protein", or "heterologous polypeptide" as used to refer to a protein, a polypeptide, or a fragment or domain of a polypeptide, refers to a protein, a polypeptide, or a fragment or domain of a polypeptide that is not normally found in a given cell in nature. As used herein, a "heterologous sequence" or a "heterologous nucleic acid" refers to a nucleic acid that is not normally found in a given cell in nature. In some embodiments, the heterologous protein or heterologous nucleic acid is exogenously introduced into a given cell. A "heterologous nucleic acid" includes a native gene, or fragment thereof, that has been introduced into the host cell in a form that is different from the corresponding native gene. For example, a heterologous nucleic acid may include a native gene coding sequence that is engineered as a chimeric gene to include a native coding sequence and non-native regulatory regions, which may then be introduced into a host cell. A heterologous gene may also include a native gene, or fragment thereof, introduced into a non-native host cell. Thus, a heterologous gene may be foreign or native to the recipient cell; a nucleic acid sequence that is naturally found in a given cell but expresses an unnatural amount of the nucleic acid and/or the polypeptide which it encodes; and/or two or more nucleic acid sequences that are not found in the same relationship to each other in nature, e.g., a native nucleic acid sequence operably-linked to a non-native regulatory nucleic acid sequence.

As used herein, the term "gRNA molecule" or "gRNA" refers to a guide RNA which is capable of targeting a Cas9 molecule to a target nucleic acid. In one embodiment, the term "gRNA molecule" refers to a gRNA. In another embodiment, the term "gRNA molecule" refers to a nucleic acid encoding a gRNA.

"Linker", as that term is used herein, refers to a sequence comprising at least one amino acid. Typically it is disposed between sequences or domains of a Cas9 molecule. In one embodiment, the linker is disposed between the amino acid residues that flank a deletion. In one embodiment, the linker is disposed between the amino acid residues of a Cas9 core domain and an altered PI domain. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the linker is located immediately C-terminal to the amino acid residue $_{CT}3$ and immediately N-terminal to the amino acid residue $_{CT}7$. Preferably, the linker is selected such that the Cas9 molecule exhibits a tertiary structure or folded conformation similar to that of the corresponding naturally occurring Cas9 molecule, such that some Cas9 activity is retained. Suitable linkers are described herein. In one embodiment, the linker comprises a combination of Gly and Ser residues, e.g., (GS), or (GGS)$_x$, where x is 1, 2, 3, 4, 5, 6, 7, 8, 9 or 10 (SEQ ID NO: 1 and SEQ ID NO: 2, respectively). In one embodiment, the linker comprises a linker comprising the amino acid sequence SGSETPGTS- ESATPES (SEQ ID NO: 3), referred to herein as "XTEN linker" or "XTEN". Alternative linkers include (GSAGSAAGSGEF)$_x$, wherein x is 1, 2, 3 or 4 (SEQ ID NO: 4) and (SIVAQLSRPDPA)$_x$, wherein x is 1, 2, 3 or 4 (SEQ ID NO: 5). Linkers also include a combination of linkers described herein or known in the art.

"REC deletion", as that term is used herein, refers to a REC2 deletion, a REC1$_{CT}$ deletion, or a REC1$_{SUB}$ deletion.

"REC2 deletion", as that term is used herein, refers to a deletion of at least 10% of the amino acid residues of the REC2 domain.

"REC2 domain", as that term is used herein, refers to a region, in the N terminal half of a naturally occurring Cas9 molecule that is not needed for cleavage or gRNA-mediated targeting. Its length and boundaries differ between Cas 9 molecules from various species. In the case of S. aureus, the REC2 domain is about 41 amino acid residues in length and corresponds, approximately, to residues 126 to 166, of S. aureus Cas9. In the case of S. pyogenes, the REC2 domain is about 139 amino acid residues in length and corresponds, approximately, to residues 176 to 314 of S. pyogenes Cas9. In the case of C. jejuni, the REC2 domain is about 45 amino acid residues in length and corresponds, approximately, to residues 137 to 181 of C. jejuni Cas9. These, and the approximate sizes and boundaries of REC2 domains from the Cas9 of other species are known in the art.

"REC1$_{CT}$ deletion", as that term is used herein, refers to a deletion of at least 10% of the amino acid residues of the REC1$_{CT}$ domain.

"REC1$_{CT}$ domain", as that term is used herein, refers to a region, C terminal of the REC1 domain, of a naturally occurring Cas9 polypeptide that is not needed for cleavage or gRNA-mediated targeting. Its length and boundaries differ between Cas 9 proteins from various species. In the case of S. aureus, the REC1$_{CT}$ domain is about 146 amino acid residues in length and corresponds, approximately, to residues 288 to 166, of S. aureus Cas9. In the case of S. pyogenes, the REC1$_{CT}$ domain is about 219 amino acid residues in length and corresponds, approximately, to residues 500 to 718 of S. pyogenes Cas9. In the case of C. jejuni, the REC1$_{CT}$ domain is about 134 amino acid residues in length and corresponds, approximately, to residues 305 to 438 of C. jejuni Cas9. These, and the approximate sizes and boundaries of REC1$_{CT}$ domains from other species are known in the art.

"REC1$_{SUB}$ deletion", as that term is used herein, refers to a deletion of at least 10% of the amino acid residues of the REC1$_{SUB}$ domain.

"REC1$_{SUB}$ domain", as that term is used herein, refers to a region, located within the REC1$_{CT}$ domain, of a naturally occurring Cas9 polypeptide that is not needed for cleavage or gRNA-mediated targeting. Its length and boundaries differ between Cas 9 proteins from various species. In the case of S. aureus, the REC1$_{SUB}$ domain is about 57 amino acid residues in length and corresponds, approximately, to residues 296 to 352, of S. aureus Cas9. In the case of S. pyogenes, the REC1$_{SUB}$ domain is about 82 amino acid residues in length and corresponds, approximately, to residues 511 to 592 of S. pyogenes Cas9. In the case of C. jejuni, the REC1$_{SUB}$ domain is about 45 amino acid residues in length and corresponds, approximately, to residues 316 to 360 of C. jejuni Cas9. These, and the approximate sizes and boundaries of REC1$_{SUB}$ domains from other species are known in the art.

"n" as used herein in the context of proteins or Cas9 molecules described herein, refers to the number of amino acid residues that are deleted in a REC2, REC1$_{CT}$, or REC1$_{SUB}$ deletion, unless otherwise specified.

"X" as used herein in the context of an amino acid sequence of a linker sequence, refers to any number of repeating units unless otherwise specified.

"X" as used herein in the context of a Cas9 molecule or core domain, e.g., "species X Cas9" designates the species from which the Cas9 molecule or core domain is derived from.

A disorder "caused by" a mutation, as used herein, refers to a disorder that is made more likely or severe by the presence of the mutation, compared to a subject that does not have the mutation. The mutation need not be the only cause of a disorder, i.e., the disorder can still be caused by the mutation even if other causes, such as environmental factors or lifestyle factors, contribute causally to the disorder. In one embodiment, the disorder is caused by the mutation if the mutation is a medically recognized risk factor for developing the disorder, and/or if a study has found that the mutation correlates with development of the disorder.

"Domain", as used herein, is used to describe segments of a protein or nucleic acid. Unless otherwise indicated, a domain is not required to have any specific functional property.

"HDR", or homology-directed repair, as used herein, refers to the process of repairing DNA damage using a homologous nucleic acid (e.g., a sister chromatid or an exogenous nucleic acid, e.g., a template nucleic acid). HDR typically occurs when there has been significant resection at a double strand break, forming at least one single stranded portion of DNA. HDR is a category that includes, for example, single-strand annealing (SSA), homologous recombination (HR), and a third, not yet fully characterized alternative homologous recombination (alt-HR) DNA repair pathway. In some embodiments, the term HDR does not encompass canonical NHEJ (C-NHEJ). In some embodiments, the term HDR does not encompass alternative non-homologous end joining (Alt-NHEJ) (e.g., blunt end-joining (blunt EJ), (micro homology mediated end joining (MMEJ), and synthesis dependent microhomology-mediated end joining (SD-MMEJ)).

"Canonical NHEJ", or canonical non-homologous end joining, as used herein, refers to the process of repairing double strand breaks in which the break ends are directly ligated. This process does not require a homologous nucleic acid to guide the repair, and can result in the deletion or insertion of one or more nucleotides. This process requires the Ku heterodimer (Ku70/Ku80), the catalytic subunit of DNA-PK (DN-PKcs), and DNA ligase XRCC4/LIG4.

"ALT-NHEJ" or "alternative NHEJ", or alternative non-homologous end joining, as used herein, is a type of alternative end joining repair process, and utilizes a different pathway than that of canonical NHEJ. In alternative NHEJ, a small degree of resection occurs at the break ends on both sides of the break to reveal single-stranded overhangs. Ligation or annealing of the overhangs results in the deletion of sequence. ALT-NHEJ is a category that includes micro-homology-mediated end joining (MMEJ), blunt end joining (EJ), and synthesis dependent microhomology-mediated end joining (SD-MMEJ). In MMEJ, a limited amount of resection occurs and there is microhomology at the break site (typically 5-25 bp); MMEJ is one of the most abundant and characterized types of alt-NHEJ. In SD-MMEJ, there is de novo synthesis by an accurate non-processive DNA polymerase that creates microhomology.

The term, "HR" refers to a type of HDR DNA-repair which typically acts occurs when there has been significant resection at the double strand break, forming at least one single stranded portion of DNA. In a normal cell, HR" or "Homologous recombination" typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

"ALT-HR" or "alternative HR", or alternative homology repair pathway, as used herein, refers to the process of repairing DNA damage using a homologous nucleic acid (e.g., a sister chromatid or an exogenous nucleic acid, e.g., a template nucleic acid). ALT-HR is distinct from HR in that the process utilizes different pathways from canonical HR, and can be inhibited by the HR mediators, RAD51 and BRCA2. Also, ALT-HR uses a single-stranded or nicked homologous nucleic acid for repair of the break.

"SSA" or "Single Strand Annealing", as used herein, refers to the process where RAD52 as opposed to RAD51 in the HR pathways, binds to the single stranded portion of DNA and promotes annealing of the two single stranded DNA segments at repetitive regions. Once RAD52 binds XFP/ERCC1 removes DNA flaps to make the DNA more suitable for ligation.

"Landmark" or "landmark position", as used herein, refers to a nucleotide in a target nucleic acid.

"Large molecule", as used herein, refers to a molecule having a molecular weight of at least 2, 3, 5, 10, 20, 30, 40, 50, 60, 70, 80, 90, or 100 kDa. Large molecules include proteins, polypeptides, nucleic acids, biologics, and carbohydrates.

"Polypeptide", as used herein, refers to a polymer of amino acids.

A "reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule, is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of S. pyogenes, or S. thermophilus. In one embodiment, the reference Cas9 molecule is the naturally occurring Cas9 molecule having the closest sequence identity or homology with the Cas9 molecule to which it is being compared. In one embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Resection", as used herein, refers to exonuclease-mediated digestion of one strand of a double-stranded DNA molecule, which results in a single-stranded overhang. Resection may occur, e.g., on one or both sides of a double-stranded break. Resection, can be measured by, for instance, extracting genomic DNA, digesting it with an enzyme that selectively degrades dsDNA, and performing quantitative PCR using primers spanning the DSB site, e.g., as described herein.

An "RMEM", or "Repair-Modulating Enzyme Molecule", as that terms are used herein, refer to a molecule which when co-expressed with a Cas9 molecule, or provided in combination with a Cas9 molecule, mediates repair of a Cas9 molecule-induced cleavage event, e.g., a single or double stranded break, in a target DNA. In one embodiment, the RMEM mediates or modulates the repair pathway used by a cell to repair a Cas9 molecule induced cleavage event, e.g., the probability of a first pathway being used to repair the cleavage event is altered, e.g, increased or decreased, e.g., as compared to what would be seen in a similar system but with a Cas9 molecule as opposed to a Cas9 molecule expressed with or provided in combination with an RMEM.

In one embodiment, the RMEM is an endonuclease, exonuclease, DNA helicase, terminal deoxynucleotidy transferase, a DNA repair protein, a telomeric protein, a transcription activator, a recombinant protein, a histone acetylase, a histone deacetylase, a histone methylation protein, a chromatin remodeling protein, or a histone chaperone. In one embodiment, a RMEM interacts with, e.g., makes or breaks a covalent bond, or alters the secondary, or tertiary structure of a DNA. Examples include a RMEM having endonuclease, exonuclease, or helicase activity. In one embodiment, a RMEM interacts with, e.g., makes or breaks a covalent bond, or alters the secondary, tertiary or quaternary structure of a chromatin protein, e.g., a histone. In one embodiment, a RMEM comprises histone acetyltransferase activity, histone deacetylase activity, or histone methyltransferase activity. In one embodiment, a RMEM modifies chromatin structure, e.g., relaxes chromatin or promotes chromatin assembly or chromatin remodeling. In one embodiment the RMEM, in nature, mediates repair of DNA. In one embodiment the RMEM, in nature, does not mediate repair of DNA. In one embodiment the RMEM, in nature, modifies a chromatin related protein, e.g., a histone. In one embodiment the RMEM, in nature, does not modifies a chromatin related protein, e.g., a histone.

In one embodiment, an RMEM, as the term is used herein, does not include CtP and Mutans, Mre11, Dna2, Fen1, Trex2, Exo1, XPG, XPF, APE-1, APLF, APTX, Artemis, Mus 81, ERCC1, WRN, BLM, RECQL4, RECQL1, XPB, XPD, FancJ/Bach1, RTEL, 53Bp1 dominant negative, VP64, Rad52, Rad51, Rad51B, Rad51C, XRCC3, Tip60/KAT5, SETD2, or INO80 complex. In one embodiment, an RMEM does not include Rad52. In one embodiment, an RMEM does not include 53BP1. In one embodiment, an RMEM does not include Rad51. In one embodiment, an RMEM does not include RPA. In one embodiment, an RMEM does not include Artemis. In one embodiment, an RMEM does not include ERCC1. In one embodiment, an RMEM does not include Rad52, 53BP1, Rad51, RPA, Artemis or ERCC1.

An "RMEM molecule," as used herein, refers to a, "RMEM polypeptide" or a nucleic acid encoding an RMEM polypeptide. An "RMEM polypeptide" refers to a polypeptide having at least 80% identity to a RMEM polypeptide disclosed herein, or a fragment thereof which retains the activity of the wild-type RMEM polypeptide. In one embodiment, an "RMEM polypeptide" refers to a fragment or domain of a full-length RMEM molecule, but which retains the activity of the wild-type RMEM polypeptide. In some embodiments, the nucleic acid encoding an RMEM refers to a DNA molecule or a RNA molecule (e.g., a mRNA molecule) encoding a RMEM polypeptide. In one embodiment, the nucleic acid encoding an RMEM has at least 80% identity to a nucleic acid encoding an RMEM disclosed herein. In some embodiments, the RMEM is a eukaryotic homolog or ortholog of a RMEM molecule disclosed herein. In some embodiments, the RMEM is a mammalian homolog or ortholog of a RMEM disclosed herein. In some embodiments, the RMEM is a non-human homolog or ortholog of a RMEM disclosed herein. In some embodiments, the RMEM is derived from a bacteria, a yeast, a plant, an insect, a mammal, a rodent, a non-human primate, or a human.

In one embodiment, the RMEM comprises at least 60, 70, 80, 90, 95, 98, 99 or 100% homology with, or differs by no more than 50, 40, 30, 20, 15, 10, 5, 4, 3, 2, or 1, amino acid residues from, a naturally occurring enzyme, e.g., an enzyme disclosed herein. In another embodiment, the RMEM comprises a functional fragment of a naturally occurring enzyme, e.g., an enzyme disclosed herein. In one embodiment, the functional fragment comprises at least 5, 10, 15, 20, 25, 30, 35, 40, 45, 50, 55, 60, 65, 70, 75, 80, 85, 90, or 95% amino acid residues of the naturally occurring enzyme, e.g., an enzyme disclosed herein.

"Small molecule", as used herein, refers to a compound having a molecular weight less than about 2 kDa, e.g., less than about 2 kDa, less than about 1.5 kDa, less than about 1 kDa, or less than about 0.75 kDa.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In one embodiment, the subject is a human. In another embodiment, the subject is poultry. In another embodiment, the subject is a fish.

A "synthetic Cas9 molecule", or "Syn-Cas9 molecule", as that term is used herein, refers to a Cas9 molecule that comprises a Cas9 core domain from one bacterial species and a functional altered PI domain, i.e., a PI domain other than that naturally associated with the Cas9 core domain, e.g., from a different bacterial species. Syn-Cas9 polypeptides are also provided.

"Treat", "treating", and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"Prevent," "preventing" and "prevention," as used herein, means the prevention of a disease in a subject, e.g., a mammal, e.g., in a human, including (a) avoiding or precluding the disease; (2) affecting the predisposition toward the disease, e.g., preventing at least one symptom of the disease or to delay onset of at least one symptom of the disease.

"Target position" as used herein, refers to a site on a target nucleic acid (e.g., the chromosome) that is modified by a Cas9 molecule-dependent process. For example, the target position can be modified by a Cas9 molecule-mediated cleavage of the target nucleic acid and template nucleic acid directed modification, e.g., correction, of the target position. In another embodiment, a template nucleic acid is not used. In one embodiment, a target position can be a site between two nucleotides, e.g., adjacent nucleotides, on the template nucleic acid into which one or more nucleotides is added. The target position may comprise one or more nucleotides that are altered, e.g., corrected, by a template nucleic acid. In one embodiment, the target position is within a "target sequence" (e.g., the sequence to which the gRNA binds). In one embodiment, a target position is upstream or downstream of a target sequence (e.g., the sequence to which the gRNA binds).

The "targeting domain" of the gRNA is complementary to the "target domain" on the target nucleic acid.

A "target sequence" is the sequence of a target domain.

As used herein, the term "target nucleic acid" refers to a nucleic acid which is being targeted for alteration by a Cas9 system described herein. In one embodiment, a target nucleic acid comprise one gene. In another embodiment, a target nucleic acid may comprise one or more genes, e.g., two genes, three genes, four genes, or five genes.

A "template nucleic acid," as that term is used herein, refers to a nucleic acid sequence which can be used in conjunction with a Cas9 molecule and a gRNA molecule to alter the structure of a target position. "Template nucleic acid" is used interchangeably with "donor template" herein. In one embodiment, the target nucleic acid is modified to have the some or all of the sequence of the template nucleic acid, typically at or near cleavage site(s). In one embodiment, the template nucleic acid is single stranded. In another embodiment, the single-stranded template nucleic acid (e.g., a single stranded oligonucleotide) includes at least a portion of a transgene. In an alternate embodiment, the template nucleic acid is double stranded. In one embodiment, the template nucleic acid is DNA, e.g., double stranded DNA. In an alternate embodiment, the template nucleic acid is single stranded DNA. In one embodiment, the template nucleic acid is RNA, e.g., double stranded RNA or single stranded RNA. In one embodiment, the template nucleic acid is encoded on the same vector backbone, e.g. AAV genome, plasmid DNA, as the Cas9 and gRNA. In one embodiment, the template nucleic acid is excised from a vector backbone in vivo, e.g., it is flanked by gRNA recognition sequences. In another embodiment, the template nucleic acid is an endogenous nucleic acid sequence. In one embodiment, the template nucleic acid is a single stranded oligonucleotide corresponding to a plus strand of a nucleic acid sequence. In another embodiment, the template nucleic acid is a single stranded oligonucleotide corresponding to a minus strand of a nucleic acid sequence.

I. Genome Editing Systems

The term "genome editing system" refers to any system having RNA-guided DNA editing activity. Genome editing systems of the present disclosure include at least two components adapted from naturally occurring CRISPR systems: a guide RNA (gRNA) and an RNA-guided nuclease. These two components form a complex that is capable of associating with a specific nucleic acid sequence and editing the DNA in or around that nucleic acid sequence, for instance by making one or more of a single-strand break (an SSB or nick), a double-strand break (a DSB) and/or a point mutation. Genome editing systems are discussed in more detail, herein.

Naturally occurring CRISPR systems are organized evolutionarily into two classes and five types (Makarova et al. Nat Rev Microbiol. 2011 June; 9(6): 467-477 (Makarova), incorporated by reference herein), and while genome editing systems of the present disclosure may adapt components of any type or class of naturally occurring CRISPR system, the embodiments presented herein are generally adapted from Class 2, and type II or V CRISPR systems. Class 2 systems, which encompass types II and V, are characterized by relatively large, multidomain RNA-guided nuclease proteins (e.g., Cas9 or Cpf1) and one or more guide RNAs (e.g., a crRNA and, optionally, a tracrRNA) that form ribonucleoprotein (RNP) complexes that associate with (i.e. target) and cleave specific loci complementary to a targeting (or spacer) sequence of the crRNA. Genome editing systems according to the present disclosure similarly target and edit cellular DNA sequences, but differ significantly from CRISPR systems occurring in nature. For example, the unimolecular guide RNAs described herein do not occur in nature, and both guide RNAs and RNA-guided nucleases according to this disclosure may incorporate any number of non-naturally occurring modifications.

Genome editing systems can be implemented (e.g., administered or delivered to a cell or a subject) in a variety of ways, and different implementations may be suitable for distinct applications. For instance, a genome editing system is implemented, in certain embodiments, as a protein/RNA complex (a ribonucleoprotein, or RNP), which can be included in a pharmaceutical composition that optionally includes a pharmaceutically acceptable carrier and/or an encapsulating agent, such as a lipid or polymer micro- or nano-particle, micelle, liposome, etc. In certain embodiments, a genome editing system is implemented as one or more nucleic acids encoding the RNA-guided nuclease and guide RNA components described above (optionally with one or more additional components); in certain embodiments, the genome editing system is implemented as one or more vectors comprising such nucleic acids, for instance a viral vector such as an adeno-associated virus; and in certain embodiments, the genome editing system is implemented as a combination of any of the foregoing. Additional or modified implementations that operate according to the principles set forth herein will be apparent to the skilled artisan and are within the scope of this disclosure.

It should be noted that the genome editing systems of the present disclosure can be targeted to a single specific nucleotide sequence, or may be targeted to—and capable of editing in parallel—two or more specific nucleotide sequences through the use of two or more guide RNAs. The use of multiple gRNAs is referred to as "multiplexing" throughout this disclosure, and can be employed to target multiple, unrelated target sequences of interest, or to form multiple SSBs or DSBs within a single target domain and, in some cases, to generate specific edits within such target domain. For example, International Patent Publication No. WO 2015/138510 by Maeder et al. (Maeder), which is incorporated by reference herein, describes a genome editing system for correcting a point mutation (C.2991+1655A to G) in the human CEP290 gene that results in the creation of a cryptic splice site, which in turn reduces or eliminates the function of the gene. The genome editing system of Maeder utilizes two guide RNAs targeted to sequences on either side of (i.e. flanking) the point mutation, and forms DSBs that flank the mutation. This, in turn, promotes deletion of the intervening sequence, including the mutation, thereby eliminating the cryptic splice site and restoring normal gene function.

As another example, WO 2016/073990 by Cotta-Ramusino, et al. ("Cotta-Ramusino"), incorporated by reference herein, describes a genome editing system that utilizes two gRNAs in combination with a Cas9 nickase (a Cas9 that makes a single strand nick such as *S. pyogenes* D10A), an arrangement termed a "dual-nickase system." The dual-nickase system of Cotta-Ramusino is configured to make two nicks on opposite strands of a sequence of interest that are offset by one or more nucleotides, which nicks combine to create a double strand break having an overhang (5' in the case of Cotta-Ramusino, though 3' overhangs are also possible). The overhang, in turn, can facilitate homology directed repair events in some circumstances. And, as another example, WO 2015/070083 by Palestrant et al. ("Palestrant", incorporated by reference herein) describes a gRNA targeted to a nucleotide sequence encoding Cas9 (referred to as a "governing RNA"), which can be included in a genome editing system comprising one or more additional gRNAs to permit transient expression of a Cas9 that might otherwise be constitutively expressed, for example in some virally transduced cells. These multiplexing applications are intended to be exemplary, rather than limiting, and the skilled artisan will appreciate that other applications of multiplexing are generally compatible with the genome editing systems described here.

Genome editing systems can, in some instances, form double strand breaks that are repaired by cellular DNA double-strand break mechanisms such as NHEJ or HDR. These mechanisms are described throughout the literature, for example by Davis & Maizels, PNAS, 111(10):E924-932, Mar. 11, 2014 (Davis) (describing Alt-HDR); Frit et al. DNA Repair 17(2014) 81-97 (Frit) (describing Alt-NHEJ); and Iyama and Wilson III, DNA Repair (Amst.) 2013-August; 12(8): 620-636 (Iyama) (describing canonical HDR and NHEJ pathways generally).

Where genome editing systems operate by forming DSBs, such systems optionally include one or more components that promote or facilitate a particular mode of double-strand break repair or a particular repair outcome. For instance, Cotta-Ramusino also describes genome editing systems in which a single stranded oligonucleotide "donor template" is added; the donor template is incorporated into a target region of cellular DNA that is cleaved by the genome editing system, and can result in a change in the target sequence.

In certain embodiments, genome editing systems modify a target sequence, or modify expression of a gene in or near the target sequence, without causing single- or double-strand breaks. For example, a genome editing system may include an RNA-guided nuclease fused to a functional domain that acts on DNA, thereby modifying the target sequence or its expression. As one example, an RNA-guided nuclease can be connected to (e.g., fused to) a cytidine deaminase functional domain, and may operate by generating targeted C-to-A substitutions. Exemplary nuclease/deaminase fusions are described in Komor et al. Nature 533, 420-424 (19 May 2016) ("Komor"), which is incorporated by reference. Alternatively, a genome editing system may utilize a cleavage-inactivated (i.e., a "dead") nuclease, such as a dead Cas9 (dCas9), and may operate by forming stable complexes on one or more targeted regions of cellular DNA, thereby interfering with functions involving the targeted region(s) including, without limitation, mRNA transcription, chromatin remodeling, etc.

The present disclosure provides a genome editing system comprising (a) a gRNA molecule, (b) a RNA-guided nuclease molecule, and (c) a heterologous Repair-Modulating Enzyme Molecule (RMEM), wherein the RMEM is Rad52, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid i) to comprise a deletion is decreased, ii) using gene conversion is decreased; and/or iii) using gene correction is increased in the presence of the RMEM, as compared to a frequency of the DNA repair pathway repairing the target nucleic acid i) to comprise a deletion, ii) using gene conversion, and/or iii) using gene correction in the absence of the RMEM. In certain embodiments, the frequency of a deletion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In other embodiments, the frequency of gene conversion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In yet other embodiments, the frequency of gene correction is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is 53BP1 dominant negative, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid, i) using gene conversion is increased, ii) using gene correction is increased; and/or iii) to comprise an insertion is decreased in the presence of the RMEM, as compared to a frequency of the DNA repair pathway repairing the target nucleic acid i) using gene conversion, ii) using gene correction, and/or iii) to comprise an insertion in the absence of the RMEM. In certain embodiments, the frequency of gene conversion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In yet other embodiments, the frequency of gene correction is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In yet other embodiments, the frequency of an insertion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is TdT, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM; and wherein the frequency of the DNA repair pathway repairing the target nucleic acid: i) using gene conversion is decreased; ii) using gene correction is decreased; iii) to comprise an insertion is increased; and/or iv) to comprise a deletion is decreased; in the presence of the RMEM, as compared to a frequency of the DNA repair pathway repairing the target nucleic acid i) using gene conversion, ii) using gene correction, iii) to comprise an insertion, and/or iv) to comprise a deletion in the absence of the RMEM. In certain embodiments, the frequency of gene conversion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In yet other embodiments, the frequency of gene correction is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In other embodiments, the frequency of an insertion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In yet another embodiment, the frequency of a deletion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is Rad51, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid: i) using gene conversion is decreased; and/or ii) using gene correction is decreased, in the presence of the RMEM, as compared to a frequency of the DNA repair pathway repairing the target nucleic acid i) using gene conversion and/or ii) using gene correction in the absence of the RMEM. In certain embodiments, the frequency of gene conversion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In other embodiments, the frequency of gene correction is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is RPA, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM; and wherein the frequency of the DNA repair pathway repairing the target nucleic acid using gene conversion is decreased in the presence of the RMEM, as compared to a frequency of the DNA repair pathway repairing the target nucleic acid using gene conversion in the absence of the RMEM. In certain embodiments, the frequency of gene conversion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is Artemis, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid to comprise a deletion is increased in the presence of the RMEM, as compared to a frequency of the DNA repair pathway repairing the target nucleic acid to comprise a deletion in the absence of the RMEM. In certain embodiments, the frequency of a deletion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is T5 exonuclease, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid: i) using gene correction is decreased; and/or ii) to comprise an insertion is decreased; in the presence of the RMEM, as compared to a frequency of the DNA repair pathway repairing the target nucleic acid i) using gene correction and/or ii) to comprise an insertion in the absence of the RMEM. In certain embodiments, the frequency of gene correction is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold. In other embodiments, the frequency of an insertion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a genome editing system comprising (a) a gRNA molecule, (b) a RNA-guided nuclease molecule, and (c) a heterologous Repair-Modulating Enzyme Molecule (RMEM), wherein the RMEM is ERCC1, wherein the gRNA molecule and the RNA-guided nuclease molecule are configured to associate with a target nucleic acid, resulting in a cleavage event, wherein the cleavage event is repaired by at least one DNA repair pathway that is modulated by the RMEM, and wherein the frequency of the DNA repair pathway repairing the target nucleic acid using gene conversion is decreased in the presence of the RMEM, as compared to a frequency of the DNA repair pathway repairing the target nucleic acid using gene conversion in the absence of the RMEM. In certain embodiments, the frequency of gene conversion is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

II. gRNA Molecules

A gRNA molecule, as that term is used herein, refers to a nucleic acid that promotes the specific targeting or homing of a gRNA molecule/RNA-guided nuclease molecule complex to a target nucleic acid. Typically, the nucleic acid will incorporate the functions or structure of both crRNA and tracrRNA, e.g., the functions of processed or mature crRNA and of processed or mature tracrRNA. gRNA molecules can be unimolecular (having a single nucleic acid molecule, e.g., which incorporates both crRNA function or structure and the tracrRNA function or structure), sometimes referred to herein as "chimeric" gRNAs, or modular (comprising more than one, and typically two, separate nucleic acid molecules, e.g., where one incorporates the crRNA function or structure and the other incorporates the tracrRNA function or structure). A gRNA molecule comprises a number of domains. The gRNA molecule domains are described in more detail below. Additional details on gRNAs are provided in PCT Application WO 2015/048577, the entire contents of which are expressly incorporated herein by reference.

In one embodiment, a unimolecular, or chimeric, gRNA comprises, preferably from 5' to 3': a targeting domain (which is complementary to a target nucleic acid, and which is sometimes referred to as a spacer); a first complementarity domain; a linking domain; a second complementarity domain (which is complementary to the first complementarity domain); a proximal domain; and optionally, a tail domain. In one embodiment, the targeting domain, and first complementarity domain correspond functionally or structurally to elements of a crRNA, e.g., a mature or processed crRNA. In one embodiment, the second complementarity domain, proximal domain, and tail domain correspond functionally or structurally to elements of a tracrRNA, e.g., a processed or mature tracrRNA.

In one embodiment, a modular gRNA comprises: a first strand (which corresponds to a crRNA) comprising, preferably from 5' to 3'; a targeting domain (which is complementary to a target nucleic acid); and a first complementarity domain; and a second strand (which corresponds to a tracrRNA), comprising, preferably from 5' to 3': optionally, a 5' extension domain; a second complementarity domain; a proximal domain; and optionally, a tail domain.

The domains are discussed briefly below.

Targeting Domain

The targeting domain (which can also be referred to as a "spacer") comprises a nucleotide sequence that is complementary, e.g., at least 80, 81, 82, 83, 84, 85, 86, 87, 88, 89, 90, 91, 92, 93, 94, 95, 96, 97, 98, or 99% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). It is believed that the complementarity of the targeting domain with the target sequence contributes to specificity of the interaction of the gRNA molecule/RNA-guided nuclease molecule complex with a target nucleic acid. It is understood that in a targeting domain and target sequence pair, the uracil bases in the targeting domain will pair with the adenine bases in the target sequence. In one embodiment, the targeting domain itself comprises in the 5' to 3' direction, an optional secondary domain, and a core domain. In one embodiment, the core domain is fully complementary with the target sequence. In one embodiment, the targeting domain is 5 to 50 nucleotides in length, e.g., 10 to 30, e.g., 16, 17, 18, 19, 20, 21, 22, 23, 24, 25 or 26, nucleotides in length. The strand of the target nucleic acid with which the targeting domain is complementary is referred to herein as the complementary strand. Guidance on the selection of targeting domains can be found, e.g., in Fu Y et al. (2014) NAT. BIOTECHNOL. 32: 279-84 (doi: 10.1038/nbt.2808) and Sternberg S H et al. (2014) NATURE 507: 62-7 (doi: 10.1038/nature13011). Some or all of the nucleotides of the targeting domain can have a modification, e.g., a modification found in Section XII herein.

First Complementarity Domain

The first complementarity domain is complementary with the second complementarity domain, and In one embodiment, has sufficient complementarity to the second complementarity domain to form a duplexed region under at least some physiological conditions. In one embodiment, the first complementary domain is 5, 6, 7, 8, 9, 10, 11, 12, 13, 14, 15, 16, 17, 18, 19, 20, 21, 22, 23, 24, or 25 nucleotides in length.

In one embodiment, the first complementarity domain comprises 3 subdomains, which, in the 5' to 3' direction are: a 5' subdomain, a central subdomain, and a 3' subdomain. In one embodiment, the 5' subdomain is 4 to 9, e.g., 4, 5, 6, 7, 8 or 9 nucleotides in length. In one embodiment, the central subdomain is 1, 2, or 3, e.g., 1, nucleotide in length. In one embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementarity domain. In one embodiment, it has at least 50% homology with a first complementarity domain disclosed herein, e.g., an *S. pyogenes, S. aureus* or *S. thermophilus*, first complementarity domain.

Some or all of the nucleotides of the domain can have a modification, e.g., a modification found in Section XII herein.

Linking Domain

A linking domain serves to link the first complementarity domain with the second complementarity domain of a unimolecular gRNA. The linking domain can link the first and second complementarity domains covalently or non-covalently. In one embodiment, the linkage is covalent. In one embodiment, the linking domain covalently couples the first and second complementarity domains. In one embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In one embodiment, a linking domain is 2, 3, 4, 5, 6, 7, 8, 9, 10, 15, 20, or 25 or more nucleotides in length. In one embodiment, a linking domain is 2 to 50, 2 to 40, 2 to 30, 2 to 20, 2 to 10, or 2 to 5 nucleotides in length. In one embodiment, a linking domain shares homology with, or is derived from, a naturally occurring sequence, e.g., the sequence of a tracrRNA that is 5' to the second complementarity domain. In one embodiment, the linking domain has at least 50% homology with a linking domain disclosed herein.

Some or all of the nucleotides of the domain can have a modification, e.g., a modification found in Section XII herein.

5' Extension Domain

In one embodiment, a modular gRNA can comprise additional sequence, 5' to the second complementarity domain, referred to herein as the 5' extension domain. In one embodiment, the 5' extension domain is, 2 to 10, 2 to 9, 2 to 8, 2 to 7, 2 to 6, 2 to 5, or 2 to 4, nucleotides in length. In one embodiment, the 5' extension domain is 2, 3, 4, 5, 6, 7, 8, 9, or 10 or more nucleotides in length.

Second Complementarity Domain

The second complementarity domain is complementary with the first complementarity domain, and In one embodiment, has sufficient complementarity to the second complementarity domain to form a duplexed region under at least some physiological conditions. In one embodiment, the second complementarity domain can include sequence that lacks complementarity with the first complementarity domain, e.g., sequence that loops out from the duplexed region.

In one embodiment, the second complementarity domain is 5 to 27 nucleotides in length. In one embodiment, it is longer than the first complementarity region. In one embodiment the second complementary domain is 7 to 27 nucleotides in length. In one embodiment, the complementary domain is 5, 6, 7, 8, 9, 10, 11, 12, 13, 14, 15, 16, 17, 18, 19, 20, 21, 22, 23, 24, 25 or 26 nucleotides in length.

In one embodiment, the second complementarity domain comprises 3 subdomains, which, in the 5' to 3' direction are: a 5' subdomain, a central subdomain, and a 3' subdomain. In one embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

In one embodiment, the central subdomain is 1, 2, 3, 4 or 5, e.g., 3, nucleotides in length. In one embodiment, the 3' subdomain is 4 to 9, e.g., 4, 5, 6, 7, 8 or 9 nucleotides in length. In one embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In one embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section XII herein.

Proximal Domain

In one embodiment, the proximal domain is 5 to 20 nucleotides in length. In one embodiment, the proximal domain can share homology with or be derived from a naturally occurring proximal domain. In one embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., a modification found in Section XII herein.

Tail Domain

A broad spectrum of tail domains are suitable for use in gRNA molecules. In one embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain. In one embodiment, the tail domain includes sequences that are complementary to each other and which, under at least some physiological conditions, form a duplexed region.

In one embodiment, the tail domain is absent or is 1 to 50 nucleotides in length. In one embodiment, the tail domain can share homology with or be derived from a naturally occurring proximal tail domain. In one embodiment, it has at least 50% homology with a tail domain disclosed herein, e.g., an *S. pyogenes, S. aureus* or *S. thermophilus*, tail domain.

In one embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

In one embodiment the 3' end of the tail domain is modified to render the gRNA non-toxic to cells or whole organisms e.g., humans.

In embodiments, one or more of the gRNA domains (e.g., the targeting domain, first complementarity domain, linking domain, second complementarity domain, proximal domain, or tail domain) has at least 50, 60, 70, 80, 85, 90, or 95% homology with, or differs by no more than 1, 2, 3, 4, 5, or 6 nucleotides from, a corresponding reference domain, e.g., a naturally occurring domain of a bacterial strain disclosed herein.

In one embodiment, one or more of the gRNA domains (e.g., the targeting domain, first complementarity domain, linking domain, second complementarity domain, proximal domain, or tail domain), independently, do not comprise modifications. In one embodiment, one or more of the gRNA domains (e.g., the targeting domain, first complementarity domain, linking domain, second complementarity domain, proximal domain, or tail domain), independently, comprise one or more modifications, e.g., modifications that the render the domain less susceptible to degradation or more bio-compatible, e.g., less immunogenic. By way of example, the backbone of the domain can be modified with a phosphorothioate. In one embodiment a nucleotide of the domain can comprise a 2' modification, e.g., a 2-acetylation or a 2' methylation.

In one embodiment, a method herein involves a second gRNA which is a modular gRNA, e.g., wherein one or more nucleic acid molecules encode a modular gRNA. In other embodiments, the method involves a second gRNA which is a chimeric gRNA. In other embodiments, when the method involves a third or fourth gRNA, the third and fourth gRNA may be a modular gRNA or a chimeric gRNA. When multiple gRNAs are used, any combination of modular or chimeric gRNAs may be used.

Landmarks

Another characteristic of a gRNA molecule is its ability to position a Cas9-mediated cleavage event or break at a desired, e.g., preselected, position on the target nucleic acid. The Cas9-cleavage event can also be characterized as occurring relative to, e.g., within a predefined distance, from a landmark. In one embodiment, one can configure a gRNA such that the gRNA positions a Cas9 molecule so that the Cas9 molecule mediates cleavage, e.g., a double strand or a single strand break, at a preselected position relative to a landmark on a target nucleic acid. In one embodiment, the landmark is the target position, e.g., the nucleotide or one of the nucleotides to be corrected or altered. In one embodiment, the landmark is a position that corresponds to a position in the template nucleic acid, e.g., the 5' or 3' end of the replacement sequence, within the replacement sequence, the replacement position where the replacement position is a single nucleotide, the 5' or 3' of the template nucleic acid, or the 5' or 3' homology arm. In one embodiment, the landmark is an intron/exon boundary, the 5' or 3' end or within a coding region, the 5' or 3' end or within a transcribed region, or the 5' or 3' end or within a repeated element. In one embodiment, the preselected position is at the landmark. In one embodiment, the preselected position is away from the landmark, e.g., within 1, 5, 10, 50, 100, 200, 300, 400, or 500 nucleotides of the landmark, or at least 1, 5, 10, 25, 50 or 100 nucleotides away from the landmark, or 1 to 500, 1 to 400, 1 to 300, 1 to 200, 1 to 100, 10 to 500, 10 to 400, 10 to 300, 10 to 200 or 10 to 100 nucleotides away from the landmark.

III. Methods for Designing gRNAS

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al. (2013) SCIENCE 339(6121): 823-826; Hsu et al. (2013) NAT. BIOTECHNOL. 31(9): 827-32; Fu et al. (2014) NAT. BIOTECHNOL 32(3): 279-84; Heigwer et al., 2014 NAT. METHODS 11(2): 122-3; Bae et al. (2014) BIOINFORMATICS 30(10): 1473-5; Xiao et al. (2014) BIOINFORMATICS 30 (8): 1180-1182. Additional considerations for designing gRNAs are discussed in the section entitled "gRNA Design" in PCT Application WO 2015/048577, the entire contents of which are expressly incorporated herein by reference.

For example, a software tool can be used to optimize the choice of gRNA within a user's target sequence, e.g., to minimize total off-target activity across the genome. Off target activity may be other than cleavage. For each possible gRNA choice using S. pyogenes Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section VIII herein.

The targeting domains discussed herein can be incorporated into the gRNAs described herein.

Guide RNAs (gRNAs) for use with S. pyogenes, S. aureus and N. meningitidis Cas9 molecules are identified using a DNA sequence searching algorithm. Guide RNA design is carried out using a custom guide RNA design software based on the public tool cas-offinder (Bae et al. (2014) BIOINFORMATICS 30(10): 1473-5). Said custom guide RNA design software scores guides after calculating their genome-wide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs are ranked into tiers based on their distance to the target site, their orthogonality and presence of a 5' G (based on identification of close matches in the human genome containing a relevant PAM (e.g., in the case of S. pyogenes, a NGG PAM, in the case of S. aureus, a NNGRRT or NNGRRV PAM, and in the case of N. meningitidis, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

gRNAs are identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations: gRNA pairs should be oriented on the DNA such that PAMs are facing out and cutting with the D10A Cas9 nickase will result in 5' overhangs.

An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In one embodiment, two or more (e.g., three or four) gRNA molecules are used with one RNA-guided nuclease, e.g., Cas9 molecule. In another embodiment, when two or more (e.g., three or four) gRNAs are used with two or more RNA-guided nuclease, e.g., Cas9 molecules, at least one Cas9 molecule is from a different species than the other Cas9 molecule(s). For example, when two gRNA molecules are used with two RNA-guided nuclease molecules, one RNA-guided nuclease molecule can be from one species and the other Cas9 molecule can be from a different species. Both RNA-guided nuclease species are used to generate a single or double-strand break, as desired.

In some embodiments, the targeting domains described herein are used with a RNA-guided nuclease, e.g., Cas9, nickase molecule to generate a single strand break.

In some embodiments, the targeting domains described herein are used with a RNA-guided nuclease, e.g., Cas9, nuclease molecule to generate a double strand break.

When two gRNAs designed for use to target two RNA-guided nuclease, e.g., Cas9, molecules, one RNA-guided nuclease, e.g., Cas9, can be one species, the second RNA-guided nuclease, e.g., Cas9, can be from a different species. Both RNA-guided nuclease, e.g., Cas9, species are used to generate a single or double-strand break, as desired.

It is contemplated herein that any upstream gRNA described herein may be paired with any downstream gRNA described herein. When an upstream gRNA designed for use with one species of RNA-guided nuclease, e.g., Cas9, is paired with a downstream gRNA designed for use from a different species of RNA-guided nuclease, e.g., Cas9, both RNA-guided nuclease, e.g., Cas9, species are used to generate a single or double-strand break, as desired.

In one embodiment, the targeting domain of a gRNA molecule is configured to avoid unwanted target chromosome elements, such as repeat elements, e.g., Alu elements, in the target domain. The gRNA molecule may be a first, second, third and/or fourth gRNA molecule.

IV. RNA-Guided Nuclease Molecules

RNA-guided nucleases according to the present disclosure include, but are not limited to, naturally-occurring Class 2 CRISPR nucleases such as Cas9, and Cpf1, as well as other nucleases derived or obtained therefrom. In functional terms, RNA-guided nucleases are defined as those nucleases that: (a) interact with (e.g., complex with) a gRNA; and (b) together with the gRNA, associate with, and optionally cleave or modify, a target region of a DNA that includes (i) a sequence complementary to the targeting domain of the gRNA and, optionally, (ii) an additional sequence referred to as a "protospacer adjacent motif," or "PAM," which is described in greater detail below. As the following examples will illustrate, RNA-guided nucleases can be defined, in broad terms, by their PAM specificity and cleavage activity, even though variations may exist between individual RNA-guided nucleases that share the same PAM specificity or cleavage activity. Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the the term RNA-guided nuclease should be understood as a generic term, and not limited to any particular type (e.g., Cas9 vs. Cpf1), species (e.g., S. pyogenes vs. S. aureus) or variation (e.g., full-length vs. truncated or split; naturally-occurring PAM specificity vs. engineered PAM specificity, etc.) of RNA-guided nuclease.

The PAM sequence takes its name from its sequential relationship to the "protospacer" sequence that is complementary to gRNA targeting domains (or "spacers"). Together with protospacer sequences, PAM sequences define target regions or sequences for specific RNA-guided nuclease/gRNA combinations.

Various RNA-guided nucleases may require different sequential relationships between PAMs and protospacers. In general, Cas9s recognize PAM sequences that are 3' of the protospacer as visualized relative to the top or complementary strand:

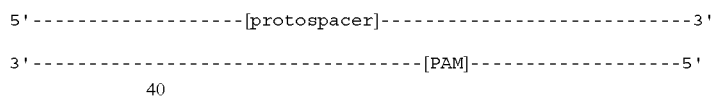

Cpf1, on the other hand, generally recognizes PAM sequences that are 5' of the protospacer:

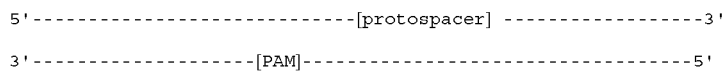

In addition to recognizing specific sequential orientations of PAMs and protospacers, RNA-guided nucleases can also recognize specific PAM sequences. S. aureus Cas9, for instance, recognizes a PAM sequence of NNGRRT or NNGRRV, wherein the N residues are immediately 3' of the region recognized by the gRNA targeting domain. S. pyogenes Cas9 recognizes NGG PAM sequences. And F. novicida Cpf1 recognizes a TTN PAM sequence. PAM sequences have been identified for a variety of RNA-guided nucleases, and a strategy for identifying novel PAM sequences has been described by Shmakov et al., 2015, Molecular Cell 60, 385-397, Nov. 5, 2015. It should also be noted that engineered RNA-guided nucleases can have PAM specificities that differ from the PAM specificities of reference molecules (for instance, in the case of an engineered RNA-guided nuclease, the reference molecule may be the naturally occurring variant from which the RNA-guided nuclease is derived, or the naturally occurring variant having the greatest amino acid sequence homology to the engineered RNA-guided nuclease).

In addition to their PAM specificity, RNA-guided nucleases can be characterized by their DNA cleavage activity: naturally-occurring RNA-guided nucleases typically form DSBs in target nucleic acids, but engineered variants have been produced that generate only SSBs (discussed above) Ran & Hsu, et al., Cell 154(6), 1380-1389, Sep. 12, 2013 (Ran), incorporated by reference herein), or that that do not cut at all.

Cas9 Molecules

Cas9 molecules of a variety of species can be used in the methods and compositions described herein. While the *S. pyogenes, S. aureus*, and *S. thermophilus* Cas9 molecules are the subject of much of the disclosure herein, Cas9 molecules, derived from, or based on the Cas9 proteins of other species listed herein can be used as well. In other words, while the much of the description herein uses *S. pyogenes* and *S. thermophilus* Cas9 molecules, Cas9 molecules from the other species can replace them, e.g., *Staphylococcus aureus* and *Neisseria meningitidis* Cas9 molecules. Additional Cas9 species include: *Acidovorax avenae, Actinobacillus pleuropneumoniae, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae*.

A Cas9 molecule, or Cas9 polypeptide, as the term is used herein, refers to a molecule or a polypeptide that can interact with a guide RNA (gRNA) molecule and, in concert with the gRNA molecule, localizes to a site which comprises a target domain, and in some embodiments, a PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule.

Cas9 Domains

Crystal structures have been determined for two different naturally occurring bacterial Cas9 molecules (Jinek et al., SCIENCE, 343(6176): 1247997, 2014) and for *S. pyogenes* Cas9 with a guide RNA (e.g., a synthetic fusion of crRNA and tracrRNA) (Nishimasu et al., CELL, 156:935-949, 2014; and Anders et al., NATURE, 2014, doi: 10.1038/nature13579).

A naturally occurring Cas9 molecule comprises two lobes: a recognition (REC) lobe and a nuclease (NUC) lobe; each of which further comprise domains described herein. The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

RuvC-Like Domain and HNH-Like Domain

In one embodiment, a Cas9 molecule or Cas9 polypeptide comprises an HNH-like domain and a RuvC-like domain. In one embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In one embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In one embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In one embodiment, a RuvC-like domain is at least 5, 6, 7, 8 amino acids in length but not more than 20, 19, 18, 17, 16 or 15 amino acids in length. In one embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In one embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

HNH-Like Domains

In one embodiment, an HNH-like domain cleaves a single stranded complementary domain, e.g., a complementary strand of a double stranded nucleic acid molecule. In one embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

Cas9 Activities Nuclease and Helicase Activities

In one embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In one embodiment, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double strand break, which In one embodiment is the presence of two nickase activities;

an endonuclease activity;

an exonuclease activity; and a helicase activity, i.e., the ability to unwind the helical structure of a double stranded nucleic acid.

In one embodiment, an enzymatically active or an eaCas9 molecule or eaCas9 polypeptide cleaves both DNA strands and results in a double strand break. In one embodiment, an eaCas9 molecule or eaCas9 polypeptide cleaves only one strand, e.g., the strand to which the gRNA hybridizes to, or the strand complementary to the strand the gRNA hybridizes with. In one embodiment, an eaCas9 molecule or eaCas9 polypeptide comprises cleavage activity associated with an HNH domain. In one embodiment, an eaCas9 molecule or eaCas9 polypeptide comprises cleavage activity associated with a RuvC domain. In one embodiment, an eaCas9 molecule or eaCas9 polypeptide comprises cleavage activity associated with an HNH domain and cleavage activity associated with a RuvC domain. In one embodiment, an eaCas9 molecule or eaCas9 polypeptide comprises an active, or cleavage competent, HNH domain and an inactive, or cleavage incompetent, RuvC domain. In one embodiment, an eaCas9 molecule or eaCas9 polypeptide comprises an inactive, or cleavage incompetent, HNH domain and an active, or cleavage competent, RuvC domain.

Some Cas9 molecules or Cas9 polypeptides have the ability to interact with a gRNA molecule, and in conjunction with the gRNA molecule, localize to a target sequence on a target nucleic acid (the target domain), but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain, and In one embodiment, a PAM sequence.

In one embodiment, the ability of an eaCas9 molecule or eaCas9 polypeptide to interact with and cleave a target nucleic acid is PAM sequence dependent. A PAM sequence is a sequence in the target nucleic acid. In one embodiment, cleavage of the target nucleic acid occurs upstream from the PAM sequence. EaCas9 molecules from different bacterial species can recognize different sequence motifs (e.g., PAM sequences). In one embodiment, an eaCas9 molecule of *S. pyogenes* recognizes the sequence motif NGG and directs cleavage of a target nucleic acid sequence 1 to 10, e.g., 3 to 5, base pairs upstream from that sequence. See, e.g., Mali et al., SCIENCE (2013) 339(6121): 823-826. In one embodiment, an eaCas9 molecule of *S. thermophilus* recognizes the sequence motif NGGNG (SEQ ID NO.: 6) and/or NNAGAAW (W=A or T) (SEQ ID NO.: 7) and directs cleavage of a target nucleic acid sequence 1 to 10, e.g., 3 to 5, base pairs upstream from these sequences. See, e.g., Horvath et al., SCIENCE (2010); 327(5962):167-170, and Deveau et al., J. BACTERIOL. 2008; 190(4): 1390-1400. In one embodiment, an eaCas9 molecule of *S. mutans* recognizes the sequence motif NGG and/or NAAR (R=A or G) (SEQ ID NO.: 8) and directs cleavage of a target nucleic acid sequence 1 to 10, e.g., 3 to 5 base pairs, upstream from this sequence. See, e.g., Deveau et al., J BACTERIOL 2008; 190(4): 1390-1400. In one embodiment, an eaCas9 molecule of *S. aureus* recognizes the sequence motif NNGRR (R=A or G) (SEQ ID NO.: 9) and directs cleavage of a target nucleic acid sequence 1 to 10, e.g., 3 to 5, base pairs upstream from that sequence. In one embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In one embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In one embodiment, an eaCas9 molecule of *S. aureus* recognizes the sequence motif NNGRRV (R=A or G) (SEQ ID NO.: 10) and directs cleavage of a target nucleic acid sequence 1 to 10, e.g., 3 to 5, base pairs upstream from that sequence. In one embodiment, an eaCas9 molecule of *N. meningitidis* recognizes the sequence motif NNNNGATT (SEQ ID NO.: 11) or NNNGCTT (R=A or G) (SEQ ID NO: 12) and directs cleavage of a target nucleic acid sequence 1 to 10, e.g., 3 to 5, base pairs upstream from that sequence. See, e.g., Hou et al. (2013) PROC. NAT'L. ACAD. SCI. USA 110(39):15644-15649. The ability of a Cas9 molecule to recognize a PAM sequence can be determined, e.g., using a transformation assay described in Jinek et al. (2012) SCIENCE 337:816. In the aforementioned embodiments, N can be any nucleotide residue, e.g., any of A, G, C or T. In one embodiment, the PAM sequence is facing outward.

As is discussed herein, Cas9 molecules can be engineered to alter the PAM specificity of the Cas9 molecule.

Exemplary naturally occurring Cas9 molecules are described in Chylinski et al. (2013) RNA BIOLOGY 10:5, 727-737. Examples include a Cas9 molecule of: *S. pyogenes* (e.g., strain SF370, MGAS 10270, MGAS 10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitidis* (Hou et al., PNAS Early Edition 2013, 1-6) and a *S. aureus* Cas9 molecule.

In one embodiment, a Cas9 molecule or Cas9 polypeptide, e.g., an eaCas9 molecule or eaCas9 polypeptide, comprises an amino acid sequence:

having 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% homology with;

differs at no more than, 2, 5, 10, 15, 20, 30, or 40% of the amino acid residues when compared with;

differs by at least 1, 2, 3, 4, 5, 6, 7, 8, 9, 10, 11, 12, 13, 14, 15, 16, 17, 18, 19, 20 amino acids, but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al. (2013) RNA BIOLOGY 10:5, 727-737; Hou et al., PNAS Early Edition 2013, 1-6. In one embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

Engineered or Altered Cas9 Molecules and Cas9 Polypeptides

Cas9 molecules and Cas9 polypeptides described herein, e.g., naturally occurring Cas9 molecules, can possess any of a number of properties, including: nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In one embodiment, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity (as compared with a naturally occurring or other reference Cas9 molecule) or altered helicase activity. As discussed herein, an engineered Cas9 molecule or Cas9 polypeptide can have nickase activity (as opposed to double strand nuclease activity). In one embodiment an engineered Cas9 molecule or Cas9 polypeptide can have an alteration that alters its size, e.g., a deletion of amino acid sequence that reduces its size, e.g., without significant effect on one or more, or any Cas9 activity. In one embodiment, an engineered Cas9 molecule or Cas9 polypeptide can comprise an alteration that affects PAM recognition. For example, an engineered Cas9 molecule can be altered to recognize a PAM sequence other than that recognized by the endogenous wild-type PI domain. In one embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecule or Cas9 polypeptide, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids), insertions, or deletions. In one embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental Cas9 molecule.

In one embodiment, a mutation or mutations do not have a substantial effect on a Cas9 activity, e.g. a Cas9 activity described herein. In one embodiment, a mutation or mutations have a substantial effect on a Cas9 activity, e.g. a Cas9 activity described herein.

Non-Cleaving and Modified-Cleavage Cas9 Molecules and Cas9 Polypeptides

In one embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from a naturally occurring Cas9 molecule, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Alterations in the Ability to Cleave One or Both Strands of a Target Nucleic Acid In one embodiment, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In one embodiment, a mutation(s) is present in a RuvC domain. In one embodiment, a mutation(s) is present in an HNH domain. In one embodiment, mutations are present in both a RuvC domain and an HNH domain.

Exemplary mutations that may be made in the RuvC domain or HNH domain with reference to the S. pyogenes Cas9 sequence include: D10A, E762A, H840A, N854A, N863A and/or D986A. Exemplary mutations that may be made in the RuvC domain with reference to the S. aureus Cas9 sequence include: N580A. In one embodiment, one gRNA molecule is used. In another embodiment, two gRNA molecules are used.

In one embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wild type, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative. In one embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In one embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S. aureus, S. pyogenes, or C. jejuni as follows: its ability to modulate, e.g., decreased or increased, cleavage of a double strand break (endonuclease and/or exonuclease activity), e.g., as compared to a naturally occurring Cas9 molecule (e.g., a Cas9 molecule of S. aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S. aureus, S. pyogenes, or C. jejuni); or the ability to cleave a nucleic acid molecule, e.g., a double stranded or single stranded nucleic acid molecule, can be eliminated.

In one embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In one embodiment, the altered Cas9 molecule is an eiCas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of S. pyogenes, S. thermophilus, S. aureus, C. jejuni or N. meningitidis. In one embodiment, the reference Cas9 molecule is the naturally occurring Cas9 molecule having the closest sequence identity or homology. In one embodiment, the eiCas9 molecule lacks substantial cleavage activity associated with a RuvC domain and cleavage activity associated with an HNH domain.

In one embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 Molecules with Altered PAM Recognition or No PAM Recognition

Naturally occurring Cas9 molecules can recognize specific PAM sequences, for example the PAM recognition sequences described above for, e.g., S. pyogenes, S. thermophilus, S. mutans, S. aureus and N. meningitidis.

In one embodiment, a Cas9 molecule or Cas9 polypeptide has the same PAM specificities as a naturally occurring Cas9 molecule. In one embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In one embodiment, a Cas9 molecule or Cas9 polypeptide can be altered, e.g., to increase length of PAM recognition sequence and/or improve Cas9 specificity to a high level of identity (e.g., 98%, 99% or 100% match between gRNA and a PAM sequence), e.g., to decrease off target sites and increase specificity. In one embodiment, the length of the PAM recognition sequence is at least 4, 5, 6, 7, 8, 9, 10 or 15 amino acids in length. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. (2011) NATURE 472(7344): 499-503. Candidate Cas9 molecules can be evaluated, e.g., by methods described in Section VIII.

In one embodiment, the Cas9 molecule is a S. pyogenes Cas9 variant. In certain embodiments, the Cas9 variant is the EQR variant. In certain embodiments, the Cas9 variant is the VRER variant. In certain embodiments, the eiCas9 molecule is a *S. pyogenes* Cas9 variant. In certain embodiments, the Cas9 variant is the EQR variant. In certain embodiments, the Cas9 variant is the VRER variant. Cas9 variants are described, for example, in Kleinstiver et al., NATURE, 523: 481-485, 2015. In some embodiments the *S. pyogenes* Cas9 variant comprises an alanine substitution at a positively charged residue (see Slaymaker et al. (2015) "Rationally engineered Cas9 nucleases with improved specificity," SCIENCE (Published online Dec. 1, 2015) [DOI: 10.1126/science.aad5227]). In some embodiments the *S. pyogenes* Cas9 variant comprises one or more of the following mutations: R780A, K810A, K848A, K855A, H982A, R976A, R1003A, and R1060A (see Slaymaker et al.). In some embodiments the *S. pyogenes* Cas9 variant comprises one or more mutations in the following amino acid residues: R780, K810, K848, K855, H982, R976, R1003, and R1060. In some embodiments, the *S. pyogenes* Cas9 variant is the K855A variant (see Slaymaker et al.). In some embodiments, the *S. pyogenes* Cas9 variant is the K810A/K1003A/R1060A variant (also known as "eSpCas9(1.0)") (see Slaymaker et al.). In some embodiments, the *S. pyogenes* Cas9 variant is the K848A/K1003A/R1060A variant (also known as "eSpCas9(1.1)") (see Slaymaker et al.).

Following identification, gRNAs can be ranked into tiers based on their distance to the target site, their orthogonality and presence of a 5' G (based on identification of close matches in the human genome containing a relevant PAM (e.g., for a *S. pyogenes* Cas9 EQR variant, the PAM may be a NGAG PAM, A NGCG PAM, a NGGG PAM, a NGTG PAM, a NGAA PAM, a NGAT PAM or a NGAC PAM).

Following identification, gRNAs can be ranked into tiers based on their distance to the target site, their orthogonality and presence of a 5' G (based on identification of close matches in the human genome containing a relevant PAM (e.g., for a *S. pyogenes* Cas9 VRER variant, the PAM may be a NGCG PAM, A NGCA PAM, a NGCT PAM, or a NGCC PAM).

In some embodiments, the Cas9 molecule is a *S. aureus* Cas9 variant. In certain embodiments, the Cas9 variant is the KKH (E782K/N968K/R1015H) variant (see Kleinstiver et al. (2015) NAT. BIOTECHNOL. doi: 10.1038/nbt.3404, the entire contents of which are expressly incorporated herein by reference). In some embodiments, the Cas9 variant is the E782K/K929R/R1015H variant (see Kleinstiver et al. (2015)). In some embodiments, the Cas9 variant is the E782K/K929R/N968K/R1015H variant (see Kleinstiver et al. (2015). In some embodiments the Cas9 variant comprises one or more mutations in one of the following residues: E782, K929, N968, R1015. In some embodiments the Cas9 variant comprises one or more of the following mutations: E782K, K929R, N968K, R1015H and R1015Q (see Kleinstiver et al. (2015)).

Following identification, gRNAs can be ranked into tiers based on their distance to the target site, their orthogonality and presence of a 5' G (based on identification of close matches in the human genome containing a relevant PAM (e.g., for a *S. aureus* Cas9 KKH variant, the PAM may be a NNNRRT PAM (e.g., a NNNAGT PAM, a NNNGGT PAM, a NNNGAT PAM, or a NNNAAT PAM).

Alterations of the PI domain, which mediates PAM recognition are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In one embodiment, the altered PI domain recognizes a PAM sequence that is different from the PAM sequence recognized by the naturally-occurring Cas9 from which the Cas9 core domain is derived. In one embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

In one embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In one embodiment, the RKR motif of the species X Cas9 is other than the RKR motif of the species Y Cas9.

In one embodiment, the RKR motif of the altered PI domain is selected from XXY, XNG, and XNQ.

In one embodiment, the Cas9 molecule further comprises a linker disposed between said Cas9 core domain and said altered PI domain.

In one embodiment, the linker comprises: a linker described elsewhere herein disposed between the Cas9 core domain and the heterologous PI domain.

In one embodiment, a Syn-Cas9 molecule may also be size-optimized, e.g., the Syn-Cas9 molecule comprises one or more deletions, and optionally one or more linkers disposed between the amino acid residues flanking the deletions. In one embodiment, a Syn-Cas9 molecule comprises a REC deletion.

Size-Optimized Cas9 Molecules

Engineered Cas9 molecules and engineered Cas9 polypeptides, as described herein, include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions, and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus, S. pyogenes,* or *C. jejuni,* Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double strand break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed herein, can be modeled onto the crystal structure of *S. pyogenes* Cas9 (Nishimasu et al. (2014) CELL, 156: 935-949) to examine the level of conservation across the selected Cas9 orthologs with respect to the three-dimensional conformation of the protein. Less conserved or unconserved regions that are located spatially distant from regions involved in Cas9 activity, e.g., the interface with a target nucleic acid molecule and/or gRNA, represent regions or domains that are candidates for deletion without substantially affecting or decreasing Cas9 activity.

REC-Optimized Cas9 Molecules

A REC-optimized Cas9 molecule, as that term is used herein, refers to a Cas9 molecule that comprises a deletion in one or both of the REC2 domain and the $REIc_T$ domain (collectively a REC deletion), wherein the deletion comprises at least 10% of the amino acid residues in the cognate domain. A REC-optimized Cas9 molecule can be an eaCas9 molecule or an eiCas9 molecule. An exemplary REC-optimized Cas9 molecule comprises:

a) a deletion selected from:
i) a REC2 deletion;
ii) a $REC1_{CT}$ deletion; or
iii) a $REC1_{SUB}$ deletion.

Optionally, a linker is disposed between the amino acid residues that flank the deletion. In one embodiment a Cas9 molecule includes only one deletion, or only two deletions. A Cas9 molecule can comprise a REC2 deletion and a $REC1_{CT}$ deletion. A Cas9 molecule can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to its cognate domain and a plurality of e.g., up to 5, 10, 15, or 20, amino acid residues C terminal to its cognate domain.

In one embodiment, a deletion does not extend beyond: its cognate domain; the N terminal amino acid residue of its cognate domain; the C terminal amino acid residue of its cognate domain.

A REC-optimized Cas9 molecule can include a linker disposed between the amino acid residues that flank the deletion. Linkers for use in generating recombinant proteins, e.g., multi-domain proteins, are known in the art (Chen et al. (2013) ADV. DRUG DELIVERY REV. 65:1357-69). Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9. Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9.

A flexible linker can be utilized in the Cas9 molecules described herein. Flexible linkers allow a certain degree of movement and/or interaction within and between the joined domains or regions of the protein. Generally, flexible linkers are composed of small, non-polar (e.g., Gly) or polar (e.g., Ser or Thr) amino acids. The small size of these amino acids provides flexibility and allows mobility of the connected domains or regions. Furthermore, the incorporation of Ser or Thr can help maintain the stability of the linker in aqueous solutions by hydrogen bonding with the water molecules, thereby reducing unfavorable interactions between the linker and the other protein moieties. Commonly used flexible linkers are comprised of sequences that primarily consist of Gly and Ser residues. Often, these flexible linkers consist of repeating units of a combination of Gly and Ser residues, e.g., $(GGS)_x$, where the number of repeating units, e.g., x, can be optimized to achieve the appropriate separation of other domains or regions of the protein.

In some cases, a rigid linker may be preferred if there is significant distance between the joined domains or regions, or to maintain a fixed distance between the joined domains or regions of a protein and independent functions of the domains/regions. Rigid linkers often have defined secondary structure, e.g., alpha helix, or other stabilizing interactions, e.g., salt bridges and disulfide bonds. Rigid linkers commonly contain multiple Pro residues, or repeating combinations of Glu-Pro or Lys-Pro because Pro imposes a strong conformation constraint due to its structure.

The linker can comprise an amino acid residue, e.g., 1, 2, 3, 4, 5, 6, 7, 8, 9, or 10 amino acid residues. Typically, the linker will comprises less than 10, 20 or 30 amino acid residues. Typically, the linker is less than 50, 40, 30, 20, 10, or 5% of the length of the deleted sequence. Suitable linkers include: $[Gly-Ser]_x$, wherein x is 1, 2, 3, 4, 5, 6, 7, 8, 9, or 10; $[Gly-Gly-Ser]_x$, wherein x is 1, 2, 3, 4, 5, 6, 7, 8, 9, or 10; [Gly-Gly-Ser]; $[Gly-Ser-Gly-Ser]_x$, wherein x is 1, 2, 3, 4, or 5; [Gly-Ser-Gly-Ser]; $(GSAGSAAGSGEF)_x$, wherein x is 1, 2, 3 or 4; $(SIVAQLSRPDPA)_x$, wherein x is 1, 2, 3 or 4; or an XTEN sequence, e.g., the XTEN sequence of SEQ ID NO: 13, or a sequence that differs therefrom by no more than 1, 2, 3, 4, 5, 6, 7, 8, 9 or 10 amino acid residues. In one embodiment linker comprises an amino acid sequence other than a sequence within REC2.

If any of the above Cas9 sequences are fused with a peptide or polypeptide at the C-terminus, it is understood that the stop codon will be removed.

Additional Cas9 molecules are discussed in the section entitled "II. Cas9 Molecules" in International Application WO2015/048577.

Nucleic Acids Encoding Cas9 Molecules

Nucleic acids encoding the Cas9 molecules or Cas9 polypeptides, e.g., an eaCas9 molecule or eaCas9 polypeptides, are provided herein.

Exemplary nucleic acids encoding Cas9 molecules are described in Cong et al., SCIENCE 2013, 399(6121): 819-823; Wang et al., CELL 2013, 153(4): 910-918; Mali et al., SCIENCE 2013, 399(6121): 823-826; Jinek et al., SCIENCE 2012, 337 (6096): 816-821.

In one embodiment, a nucleic acid encoding a Cas9 molecule, or Cas9 polypeptide, can be a synthetic nucleic acid sequence. For example, the synthetic nucleic acid molecule can be chemically modified, e.g., as described in Section XII. In one embodiment, the mRNA, e.g., coding for a Cas9 molecule, or Cas9 polypeptide, disclosed herein, has one or more, e.g., all, of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a codon that is common in the host cell. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule, or a Cas9 polypeptide, may comprise a nuclear localization sequence (NLS). Nuclear localization sequences are known in the art.

Provided below is an exemplary codon optimized nucleic acid sequence encoding a Cas9 molecule of S. pyogenes.

```
                                        (SEQ ID NO: 14)
ATGGATAAAAAGTACAGCATCGGGCTGGACATCGGTACAAACTCAGTGGG

GTGGGCCGTGATTACGGACGAGTACAAGGTACCCTCCAAAAAATTTAAAG

TGCTGGGTAACACGGACAGACACTCTATAAAGAAAAATCTTATTGGAGCC

TTGCTGTTCGACTCAGGCGAGACAGCCGAAGCCACAAGGTTGAAGCGGAC

CGCCAGGAGGCGGTATACCAGGAGAAAGAACCGCATATGCTACCTGCAAG

AAATCTTCAGTAACGAGATGGCAAAGGTTGACGATAGCTTTTTCCATCGC

CTGGAAGAATCCTTTCTTGTTGAGGAAGACAAGAAGCACGAACGGCACCC

CATCTTTGGCAATATTGTCGACGAAGTGGCATATCACGAAAAGTACCCGA

CTATCTACCACCTCAGGAAGAAGCTGGTGGACTCTACCGATAAGGCGGAC

CTCAGACTTATTTATTTGGCACTCGCCCACATGATTAAATTTAGAGGACA

TTTCTTGATCGAGGGCGACCTGAACCCGGACAACAGTGACGTCGATAAGC

TGTTCATCCAACTTGTGCAGACCTACAATCAACTGTTCGAAGAAACCCT

ATAAATGCTTCAGGAGTCGACGCTAAAGCAATCCTGTCCGCGCGCCTCTC

AAAATCTAGAAGACTTGAGAATCTGATTGCTCAGTTGCCCGGGGAAAAGA

AAAATGGATTGTTTGGCAACCTGATCGCCCTCAGTCTCGGACTGACCCCA
```

```
                                        -continued
AATTTCAAAAGTAACTTCGACCTGGCCGAAGACGCTAAGCTCCAGCTGTC

CAAGGACACATACGATGACGACCTCGACAATCTGCTGGCCCAGATTGGGG

ATCAGTACGCCGATCTCTTTTTGGCAGCAAAGAACCTGTCCGACGCCATC

CTGTTGAGCGATATCTTGAGAGTGAACACCGAAATTACTAAAGCACCCCT

TAGCGCATCTATGATCAAGCGGTACGACGAGCATCATCAGGATCTGACCC

TGCTGAAGGCTCTTGTGAGGCAACAGCTCCCCGAAAAATACAAGGAAATC

TTCTTTGACCAGAGCAAAAACGGCTACGCTGGCTATATAGATGGTGGGGC

CAGTCAGGAGGAATTCTATAAATTCATCAAGCCCATTCTCGAGAAAATGG

ACGGCACAGAGGAGTTGCTGGTCAAACTTAACAGGGAGGACCTGCTGCGG

AAGCAGCGGACCTTTGACAACGGGTCTATCCCCCACCAGATTCATCTGGG

CGAACTGCACGCAATCCTGAGGAGGCAGGAGGATTTTTATCCTTTTCTTA

AAGATAACCGCGAGAAAATAGAAAAGATTCTTACATTCAGGATCCCGTAC

TACGTGGGACCTCTCGCCCGGGGCAATTCACGGTTTGCCTGGATGACAAG

GAAGTCAGAGGAGACTATTACACCTTGGAACTTCGAAGAAGTGGTGGACA

AGGGTGCATCTGCCCAGTCTTTCATCGAGCGGATGACAAATTTTGACAAG

AACCTCCCTAATGAGAAGGTGCTGCCCAAACATTCTCTGCTCTACGAGTA

CTTTACCGTCTACAATGAACTGACTAAAGTCAAGTACGTCACCGAGGGAA

TGAGGAAGCCGGCATTCCTTAGTGGAGAACAGAAGAAGGCGATTGTAGAC

CTGTTGTTCAAGACCAACAGGAAGGTGACTGTGAAGCAACTTAAAGAAGA

CTACTTTAAGAAGATCGAATGTTTTGACAGTGTGGAAATTTCAGGGGTTG

AAGACCGCTTCAATGCGTCATTGGGGACTTACCATGATCTTCTCAAGATC

ATAAAGGACAAAGACTTCCTGGACAACGAAGAAAATGAGGATATTCTCGA

AGACATCGTCCTCACCCTGACCCTGTTCGAAGACAGGGAAATGATAGAAG

AGCGCTTGAAAACCTATGCCCACCTCTTCGACGATAAAGTTATGAAGCAG

CTGAAGCGCAGGAGATACACAGGATGGGGAAGATTGTCAAGGAAGCTGAT

CAATGGAATTAGGGATAAACAGAGTGGCAAGACCATACTGGATTTCCTCA

AATCTGATGGCTTCGCCAATAGGAACTTCATGCAACTGATTCACGATGAC

TCTCTTACCTTCAAGGAGGACATTCAAAAGGCTCAGGTGAGCGGCAGGG

AGACTCCCTTCATGAACACATCGCGAATTTGGCAGGTTCCCCCGCTATTA

AAAAGGGCATCCTTCAAACTGTCAAGGTGGTGGATGAATTGGTCAAGGTA

ATGGGCAGACATAAGCCAGAAAATATTGTGATCGAGATGGCCCGCGAAAA

CCAGACCACACAGAAGGGCCAGAAAAATAGTAGAGAGCGGATGAAGAGGA

TCGAGGAGGGCATCAAAGAGCTGGGATCTCAGATTCTCAAAGAACACCCC

GTAGAAAACACACAGCTGCAGAACGAAAAATTGTACTTGTACTATCTGCA

GAACGGCAGAGACATGTACGTCGACCAAGAACTTGATATTAATAGACTGT

CCGACTATGACGTAGACCATATCGTGCCCCAGTCCTTCCTGAAGGACGAC

TCCATTGATAACAAAGTCTTGACAAGAAGCGACAAGAACAGGGGTAAAAG

TGATAATGTGCCTAGCGAGGAGGTGGTGAAAAAAATGAAGAACTACTGGC

GACAGCTGCTTAATGCAAAGCTCATTACACAACGGAAGTTCGATAATCTG

ACGAAAGCAGAGAGAGGTGGCTTGTCTGAGTTGGACAAGGCAGGGTTTAT

TAAGCGGCAGCTGGTGGAAACTAGGCAGATCACAAAGCACGTGGCGCAGA
```

```
TTTTGGACAGCCGGATGAACACAAAATACGACGAAAATGATAAACTGATA
CGAGAGGTCAAAGTTATCACGCTGAAAAGCAAGCTGGTGTCCGATTTTCG
GAAAGACTTCCAGTTCTACAAAGTTCGCGAGATTAATAACTACCATCATG
CTCACGATGCGTACCTGAACGCTGTTGTCGGGACCGCCTTGATAAAGAAG
TACCCAAAGCTGGAATCCGAGTTCGTATACGGGGATTACAAAGTGTACGA
TGTGAGGAAAATGATAGCCAAGTCCGAGCAGGAGATTGGAAAGGCCACAG
CTAAGTACTTCTTTTATTCTAACATCATGAATTTTTTTAAGACGGAAATT
ACCCTGGCCAACGGAGAGATCAGAAAGCGGCCCCTTATAGAGACAAATGG
TGAAACAGGTGAAATCGTCTGGGATAAGGGCAGGGATTTCGCTACTGTGA
GGAAGGTGCTGAGTATGCCACAGGTAAATATCGTGAAAAAAACCGAAGTA
CAGACCGGAGGATTTTCCAAGGAAAGCATTTTGCCTAAAAGAAACTCAGA
CAAGCTCATCGCCCGCAAGAAGATTGGGACCCTAAGAAATACGGGGGAT
TTGACTCACCCACCGTAGCCTATTCTGTGCTGGTGGTAGCTAAGGTGGAA
AAAGGAAAGTCTAAGAAGCTGAAGTCCGTGAAGGAACTCTTGGGAATCAC
TATCATGGAAAGATCATCCTTTGAAAAGAACCCTATCGATTTCCTGGAGG
CTAAGGGTTACAAGGAGGTCAAGAAAGACCTCATCATTAAACTGCCAAAA
TACTCTCTCTTCGAGCTGGAAAATGGCAGGAAGAGAATGTTGGCCAGCGC
CGGAGAGCTGCAAAAGGGAAACGAGCTTGCTCTGCCCTCCAAATATGTTA
ATTTTCTCTATCTCGCTTCCCACTATGAAAAGCTGAAAGGGTCTCCCGAA
GATAACGAGCAGAAGCAGCTGTTCGTCGAACAGCACAAGCACTATCTGGA
TGAAATAATCGAACAAATAAGCGAGTTCAGCAAAGGGTTATCCTGGCGG
ATGCTAATTTGGACAAAGTACTGTCTGCTTATAACAAGCACCGGGATAAG
CCTATTAGGGAACAAGCCGAGAATATAATTCACCTCTTTACACTCACGAA
TCTCGGAGCCCCCGCCGCCTTCAAATACTTTGATACGACTATCGACCGGA
AACGGTATACCAGTACCAAAGAGGTCCTCGATGCCACCCTCATCCACCAG
TCAATTACTGGCCTGTACGAAACACGGATCGACCTCTCTCAACTGGGCGG
CGACTAG
```

Provided below is the corresponding amino acid sequence of a *S. pyogenes* Cas9 molecule.

```
                                            (SEQ ID NO: 15)
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD*
```

Provided below is an exemplary codon optimized nucleic acid sequence encoding a Cas9 molecule of *N. meningitidis*.

```
                                            (SEQ ID NO: 16)
ATGGCCGCCTTCAAGCCCAACCCCATCAACTACATCCTGGGCCTGGACAT
CGGCATCGCCAGCGTGGGCTGGGCCATGGTGGAGATCGACGAGGACGAGA
ACCCCATCGCCTGATCGACCTGGGTGTGCGCGTGTTCGAGCGCGCTGAG
GTGCCCAAGACTGGTGACAGTCTGGCTATGGCTCGCCGGCTTGCTCGCTC
TGTTCGGCGCCTTACTCGCCGGCGCGCTCACCGCCTTCTGCGCGCTCGCC
GCCTGCTGAAGCGCGAGGGTGTGCTGCAGGCTGCCGACTTCGACGAGAAC
GGCCTGATCAAGAGCCTGCCCAACACTCCTTGGCAGCTGCGCGCTGCCGC
TCTGGACCGCAAGCTGACTCCTCTGGAGTGGAGCGCCGTGCTGCTGCACC
TGATCAAGCACCGCGGCTACCTGAGCCAGCGCAAGAACGAGGGCGAGACC
GCCGACAAGGAGCTGGGTGCTCTGCTGAAGGGCGTGGCCGACAACGCCCA
CGCCCTGCAGACTGGTGACTTCCGCACTCCTGCTGAGCTGGCCCTGAACA
AGTTCGAGAAGGAGAGCGGCCACATCCGCAACCAGCGCGGCGACTACAGC
CACACCTTCAGCCGCAAGGACCTGCAGGCCGAGCTGATCCTGCTGTTCGA
GAAGCAGAAGGAGTTCGGCAACCCCACGTGAGCGGCGGCCTGAAGGAGG
GCATCGAGACCCTGCTGATGACCCAGCGCCCCGCCCTGAGCGGCGACGCC
GTGCAGAAGATGCTGGGCCACTGCACCTTCGAGCCAGCCGAGCCCAAGGC
CGCCAAGAACACCTACACCGCCGAGCGCTTCATCTGGCTGACCAAGCTGA
ACAACCTGCGCATCCTGGAGCAGGGCAGCGAGCGCCCCTGACCGACACC
GAGCGCGCCACCCTGATGGACGAGCCTACCGCAAGAGCAAGCTGACCTA
CGCCCAGGCCCGCAAGCTGCTGGGTCTGGAGGACACCGCCTTCTTCAAGG
GCCTGCGCTACGGCAAGGACAACGCCGAGGCCAGCACCCTGATGGAGATG
```

-continued
```
AAGGCCTACCACGCCATCAGCCGCGCCCTGGAGAAGGAGGGCCTGAAGGA
CAAGAAGAGTCCTCTGAACCTGAGCCCCGAGCTGCAGGACGAGATCGGCA
CCGCCTTCAGCCTGTTCAAGACCGACGAGGACATCACCGGCCGCCTGAAG
GACCGCATCCAGCCCGAGATCCTGGAGGCCCTGCTGAAGCACATCAGCTT
CGACAAGTTCGTGCAGATCAGCCTGAAGGCCCTGCGCCGCATCGTGCCCC
TGATGGAGCAGGGCAAGCGCTACGACGAGGCCTGCGCCGAGATCTACGGC
GACCACTACGGCAAGAAGAACACCGAGGAGAAGATCTACCTGCCTCCTAT
CCCCGCCGACGAGATCCGCAACCCCGTGGTGCTGCGCGCCCTGAGCCAGG
CCCGCAAGGTGATCAACGGCGTGGTGCGCCGCTACGGCAGCCCCGCCCGC
ATCCACATCGAGACCGCCCGCGAGGTGGGCAAGAGCTTCAAGGACCGCAA
GGAGATCGAGAAGCGCCAGGAGGAGAACCGCAAGGACCGCGAGAAGGCCG
CCGCCAAGTTCCGCGAGTACTTCCCCAACTTCGTGGGCGAGCCCAAGAGC
AAGGACATCCTGAAGCTGCGCCTGTACGAGCAGCAGCACGGCAAGTGCCT
GTACAGCGGCAAGGAGATCAACCTGGGCCGCCTGAACGAGAAGGGCTACG
TGGAGATCGACCACGCCCTGCCCTTCAGCCGCACCTGGGACGACAGCTTC
AACAACAAGGTGCTGGTGCTGGGCAGCGAGAACCAGAACAAGGGCAACCA
GACCCCCTACGAGTACTTCAACGGCAAGGACAACAGCCGCGAGTGGCAGG
AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA
```

Provided below is the corresponding amino acid sequence of a *N. meningitidis* Cas9 molecule.

(SEQ ID NO: 17)
```
MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*
```

Provided below is an amino acid sequence of a *S. aureus* Cas9 molecule.

(SEQ ID NO: 18)
```
MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
```

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG*

Provided below is an exemplary codon optimized nucleic acid sequence encoding a S. aureus Cas9 molecule.

(SEQ ID NO: 19)
ATGAAAAGGAACTACATTCTGGGGCTGGACATCGGGATTACAAGCGTGGG

GTATGGGATTATTGACTATGAAACAAGGGACGTGATCGACGCAGGCGTCA

GACTGTTCAAGGAGGCCAACGTGGAAAACAATGAGGGACGGAGAAGCAAG

AGGGGAGCCAGGCGCCTGAAACGACGGAGAAGGCACAGAATCCAGAGGGT

GAAGAAACTGCTGTTCGATTACAACCTGCTGACCGACCATTCTGAGCTGA

GTGGAATTAATCCTTATGAAGCCAGGGTGAAAGGCCTGAGTCAGAAGCTG

TCAGAGGAAGAGTTTTCCGCAGCTCTGCTGCACCTGGCTAAGCGCCGAGG

AGTGCATAACGTCAATGAGGTGGAAGAGGACACCGGCAACGAGCTGTCTA

CAAAGGAACAGATCTCACGCAATAGCAAAGCTCTGGAAGAGAAGTATGTC

GCAGAGCTGCAGCTGGAACGGCTGAAGAAAGATGGCGAGGTGAGAGGGTC

AATTAATAGGTTCAAGACAAGCGACTACGTCAAAGAAGCCAAGCAGCTGC

TGAAAGTGCAGAAGGCTTACCACCAGCTGGATCAGAGCTTCATCGATACT

TATATCGACCTGCTGGAGACTCGGAGAACCTACTATGAGGGACCAGGAGA

AGGGAGCCCCTTCGGATGGAAAGACATCAAGGAATGGTACGAGATGCTGA

TGGGACATTGCACCTATTTTCCAGAAGAGCTGAGAAGCGTCAAGTACGCT

TATAACGCAGATCTGTACAACGCCCTGAATGACCTGAACAACCTGGTCAT

CACCAGGGATGAAAACGAGAAACTGGAATACTATGAGAAGTTCCAGATCA

TCGAAAACGTGTTTAAGCAGAAGAAAAAGCCTACACTGAAACAGATTGCT

AAGGAGATCCTGGTCAACGAAGAGGACATCAAGGGCTACCGGGTGACAAG

CACTGGAAAACCAGAGTTCACCAATCTGAAAGTGTATCACGATATTAAGG

ACATCACAGCACGGAAAGAAATCATTGAGAACGCCGAACTGCTGGATCAG

ATTGCTAAGATCCTGACTATCTACCAGAGCTCCGAGGACATCCAGGAAGA

GCTGACTAACCTGAACAGCGAGCTGACCCAGGAAGAGATCGAACAGATTA

GTAATCTGAAGGGGTACACCGGAACACACAACCTGTCCCTGAAAGCTATC

AATCTGATTCTGGATGAGCTGTGGCATACAAACGACAATCAGATTGCAAT

CTTTAACCGGCTGAAGCTGGTCCCAAAAAAGGTGGACCTGAGTCAGCAGA

AAGAGATCCCAACCACACTGGTGGACGATTTCATTCTGTCACCCGTGGTC

AAGCGGAGCTTCATCCAGAGCATCAAAGTGATCAACGCCATCATCAAGAA

GTACGGCCTGCCCAATGATATCATTATCGAGCTGGCTAGGGAGAAGAACA

GCAAGGACGCACAGAAGATGATCAATGAGATGCAGAAACGAAACCGGCAG

ACCAATGAACGCATTGAAGAGATTATCCGAACTACCGGGAAGAGAACGC

AAAGTACCTGATTGAAAAAATCAAGCTGCACGATATGCAGGAGGGAAAGT

GTCTGTATTCTCTGGAGGCCATCCCCCTGGAGGACCTGCTGAACAATCCA

TTCAACTACGAGGTCGATCATATTATCCCCAGAAGCGTGTCCTTCGACAA

TTCCTTTAACAACAAGGTGCTGGTCAAGCAGGAAGAGAACTCTAAAAAGG

GCAATAGGACTCCTTTCCAGTACCTGTCTAGTTCAGATTCCAAGATCTCT

TACGAAACCTTTAAAAAGCACATTCTGAATCTGGCCAAAGGAAAGGGCCG

CATCAGCAAGACCAAAAAGGAGTACCTGCTGGAAGAGCGGGACATCAACA

GATTCTCCGTCCAGAAGGATTTTATTAACCGGAATCTGGTGGACACAAGA

TACGCTACTCGCGGCCTGATGAATCTGCTGCGATCCTATTTCCGGGTGAA

CAATCTGGATGTGAAAGTCAAGTCCATCAACGGCGGGTTCACATCTTTTC

TGAGGCGCAAATGGAAGTTTAAAAAGGAGCGCAACAAAGGGTACAAGCAC

CATGCCGAAGATGCTCTGATTATCGCAAATGCCGACTTCATCTTTAAGGA

GTGGAAAAAGCTGGACAAAGCCAAGAAAGTGATGGAGAACCAGATGTTCG

AAGAGAAGCAGGCCGAATCTATGCCCGAAATCGAGACAGAACAGGAGTAC

AAGGAGATTTTCATCACTCCTCACCAGATCAAGCATATCAAGGATTTCAA

GGACTACAAGTACTCTCACCGGGTGGATAAAAAGCCCAACAGAGAGCTGA

TCAATGACACCCTGTATAGTACAAGAAAAGACGATAAGGGGAATACCCTG

ATTGTGAACAATCTGAACGGACTGTACGACAAAGATAATGACAAGCTGAA

AAAGCTGATCAACAAAAGTCCCGAGAAGCTGCTGATGTACCACCATGATC

CTCAGACATATCAGAAACTGAAGCTGATTATGGAGCAGTACGGCGACGAG

AAGAACCCACTGTATAAGTACTATGAAGAGACTGGGAACTACCTGACCAA

GTATAGCAAAAAGGATAATGGCCCCGTGATCAAGAAGATCAAGTACTATG

GGAACAAGCTGAATGCCCATCTGGACATCACAGACGATTACCCTAACAGT

CGCAACAAGGTGGTCAAGCTGTCACTGAAGCCATACAGATTCGATGTCTA

TCTGGACAACGGCGTGTATAAATTTGTGACTGTCAAGAATCTGGATGTCA

TCAAAAAGGAGAACTACTATGAAGTGAATAGCAAGTGCTACGAAGAGGCT

AAAAAGCTGAAAAAGATTAGCAACCAGGCAGAGTTCATCGCCTCCTTTTA

CAACAACGACCTGATTAAGATCAATGGCGAACTGTATAGGGTCATCGGGG

TGAACAATGATCTGCTGAACCGCATTGAAGTGAATATGATTGACATCACT

TACCGAGAGTATCTGGAAAACATGAATGATAAGCGCCCCCCTCGAATTAT

CAAAACAATTGCCTCTAAGACTCAGAGTATCAAAAAGTACTCAACCGACA

TTCTGGGAAACCTGTATGAGGTGAAGAGCAAAAAGCACCCTCAGATTATC

AAAAAGGGC

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the methods disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al. (2005) PLOS COMPUTATIONAL BIOLOGY 1(6): e60, and in Makarova et al. (2011) NATURE REVIEW MICROBIOLOGY 9: 467-477, the contents of which are incorporated herein by reference in their entirety.

Cpf1

The crystal structure of *Acidaminococcus* sp. Cpf1 in complex with crRNA and a double-stranded (ds) DNA target including a TTTN PAM sequence has been solved by Yamano et al. (Cell. 2016 May 5; 165(4): 949-962 (Yamano), incorporated by reference herein). Cpf1, like Cas9, has two lobes: a REC (recognition) lobe, and a NUC (nuclease) lobe. The REC lobe includes REC1 and REC2 domains, which lack similarity to any known protein structures. The NUC lobe, meanwhile, includes three RuvC domains (RuvC-I, -II and -III) and a BH domain. However, in contrast to Cas9, the Cpf1 REC lobe lacks an HNH domain, and includes other domains that also lack similarity to known protein structures: a structurally unique PI domain, three Wedge (WED) domains (WED-I, -II and -III), and a nuclease (Nuc) domain.

While Cas9 and Cpf1 share similarities in structure and function, it should be appreciated that certain Cpf1 activities are mediated by structural domains that are not analogous to any Cas9 domains. For instance, cleavage of the complementary strand of the target DNA appears to be mediated by the Nuc domain, which differs sequentially and spatially from the HNH domain of Cas9. Additionally, the non-targeting portion of Cpf1 gRNA (the handle) adopts a psuedonot structure, rather than a stem loop structure formed by the repeat:antirepeat duplex in Cas9 gRNAs.

Modifications of RNA-Guided Nucleases

The RNA-guided nucleases described above have activities and properties that can be useful in a variety of applications, but the skilled artisan will appreciate that RNA-guided nucleases can also be modified in certain instances, to alter cleavage activity, PAM specificity, or other structural or functional features.

Turning first to modifications that alter cleavage activity, mutations that reduce or eliminate the activity of domains within the NUC lobe have been described above. Exemplary mutations that may be made in the RuvC domains, in the Cas9 HNH domain, or in the Cpf1 Nuc domain are described in Ran and Yamano, as well as in Cotta-Ramusino. In general, mutations that reduce or eliminate activity in one of the two nuclease domains result in RNA-guided nucleases with nickase activity, but it should be noted that the type of nickase activity varies depending on which domain is inactivated. As one example, inactivation of a RuvC domain of a Cas9 will result in a nickase that cleaves the complementary or top strand as shown below (where C denotes the site of cleavage):

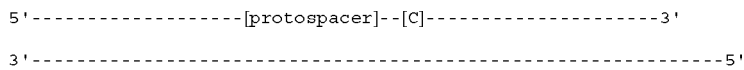

On the other hand, inactivation of a Cas9 HNH domain results in a nickase that cleaves the bottom or non-complementary strand:

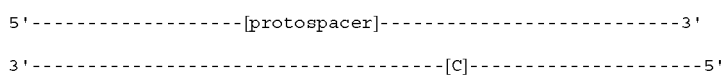

Modifications of PAM specificity relative to naturally occurring Cas9 reference molecules has been described by Kleinstiver et al. for both *S. pyogenes* (Kleinstiver et al., Nature. 2015 Jul. 23; 523(7561):481-5 (Kleinstiver I) and *S. aureus* (Kleinstiver et al., Nat Biotechnol. 2015 December; 33(12): 1293-1298 (Klienstiver II)). Kleinstiver et al. have also described modifications that improve the targeting fidelity of Cas9 (Nature, 2016 Jan. 28; 529, 490-495 (Kleinstiver III)). Each of these references is incorporated by reference herein.

RNA-guided nucleases have been split into two or more parts, as described by Zetsche et al. (Nat Biotechnol. 2015 February; 33(2):139-42 (Zetsche II), incorporated by reference), and by Fine et al. (Sci Rep. 2015 Jul. 1; 5:10777 (Fine), incorporated by reference).

RNA-guided nucleases can be, in certain embodiments, size-optimized or truncated, for instance via one or more deletions that reduce the size of the nuclease while still retaining gRNA association, target and PAM recognition, and cleavage activities. In certain embodiments, RNA guided nucleases are bound, covalently or non-covalently, to another polypeptide, nucleotide, or other structure, optionally by means of a linker. Exemplary bound nucleases and linkers are described by Guilinger et al., Nature Biotechnology 32, 577-582 (2014), which is incorporated by reference for all purposes herein.

RNA-guided nucleases also optionally include a tag, such as, but not limited to, a nuclear localization signal to facilitate movement of RNA-guided nuclease protein into the nucleus. In certain embodiments, the RNA-guided nuclease can incorporate C- and/or N-terminal nuclear localization signals. Nuclear localization sequences are known in the art and are described in Maeder and elsewhere.

The foregoing list of modifications is intended to be exemplary in nature, and the skilled artisan will appreciate, in view of the instant disclosure, that other modifications may be possible or desirable in certain applications. For brevity, therefore, exemplary systems, methods and compositions of the present disclosure are presented with reference to particular RNA-guided nucleases, but it should be understood that the RNA-guided nucleases used may be modified in ways that do not alter their operating principles. Such modifications are within the scope of the present disclosure.

V. Repair-Modulating Enzyme Molecules

The methods described herein are directed to the use of a Repair-Modulating Enzyme Molecule (RMEM), e.g., an endogenous or a heterologous RMEM, in combination with a RNA-guided nuclease, e.g., Cas9, molecule. In some embodiments, a RMEM molecule refers to naturally occurring RMEM polypeptides and nucleic acids encoding a naturally occurring RMEM, and to engineered, altered, or modified RMEM polypeptides or nucleic acids encoding a RMEM that differ, e.g., by at least one amino acid residue, from a reference sequence.

It is believed that the use of a RMEM in combination with a RNA-guided nuclease, e.g., Cas9, molecule and a gRNA molecule can modulate the DNA repair pathways that a cell utilizes to resolve or repair a Cas9-mediated cleavage event. Thus, a RNA-guided nuclease, e.g., Cas9, molecule and at least one gRNA molecule, in combination with a RMEM, can be used in the methods described herein to modulate the frequency by which a cell or a population of cells resolves or repairs a RNA-guided nuclease-mediated cleavage event using one or more of the following DNA repair pathways: resection, mismatch repair (MMR), nucleotide excision repair (NER), base excision repair (BER), canonical non-homologous end joining (canonical NHEJ), alternative non-homologous end joining (ALT-NHEJ), blunt end joining (blunt EJ), homology directed-repair (HDR), microhomology-mediated end joining (MMEJ), synthesis-dependent microhomology-mediated end joining (SD-MMEJ), single strand annealing (SSA),homologous recombination (HR), alternative homologous recombination (alt-HR), Holliday junction model or double strand break repair (DSBR), synthesis-dependent strand annealing (SDSA), single strand break repair (SSBR), translesion synthesis repair (TLS), and interstrand crosslink repair (ICL).

The RMEM and RNA-guided nuclease molecule can be selected such that a particular desired repair process, e.g., canonical NHEJ, alternative-NHEJ, or HDR, is preferentially promoted over another repair process. In one embodiment, the RMEM, when used in combination with a gRNA molecule and a RNA-guided nuclease molecule, increases one or more (e.g., 2, 3, 4, or all) of canonical NHEJ, alternative-NHEJ, or HDR as compared to the level of repair seen when a RNA-guided nuclease molecule is used in the absence of increased expression of an RMEM and/or over-expression of a heterologous RMEM. Levels of repair may be measured using methods known to one of ordinary skill in the art, for example, by sequencing of the locus. The RMEMs described herein therefore allow for increased efficiency and increased control in directing gene targeting and editing over standard gRNA and RNA-guided nuclease molecules currently used in genome editing systems.

In one embodiment, the RMEM comprises at least 60, 70, 80, 81, 82, 83, 84, 85, 86, 87, 88, 89, 90, 91, 92, 93, 94, 95, 96, 97, 98, 99 or 100% homology with, or differs by no more than 50, 40, 30, 20, 19, 18, 17, 16, 15, 14, 13, 12, 11, 10, 9, 8, 7, 6, 5, 4, 3, 2, or 1, amino acid residues from, a naturally occurring RMEM, e.g., as disclosed herein. Also encompassed herein are the various isoforms, transcription and splice variants of the naturally occurring RMEMs.

In one embodiment, the RMEM comprises a functional fragment of a naturally occurring RMEM disclosed herein. In one embodiment, the functional fragment comprises at least 5, 10, 15, 20, 25, 30, 35, 40, 45, 50, 55, 60, 65, 70, 75, 80, 81, 82, 83, 84, 85, 86, 87, 88, 89, 90, 91, 92, 93, 94, 95, 96, 97, 98, or 99% of the amino acid residues of a naturally occurring RMEM. For example, the RMEM can be a domain or a functional fragment of a domain of a naturally occurring RMEM. Functional activity of a domain or fragment of the naturally occurring enzyme described herein can be tested using functional assays for nuclease activity, helicase activity, and chromatin modifying activity known in the art.

In one embodiment, the methods of the present disclosure comprise increasing the protein level of a RMEM in a cell, as compared to the level of expression of the endogenous RMEM protein in a cell, by at least 1-fold, e.g., 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, or more. In one embodiment, the methods of the present disclosure comprise increasing the protein level of a RMEM in a cell, as compared to the endogenous RMEM protein level in a cell, by at least 10%, e.g., 10, 20, 30, 40, 50, 60, 70, 80, 90, 100, 150, 200, 250, 300, 400, 500, 600, 700, 800, 900, 1000, 1100, 1200, 1300, 1400, 1500, 1600, 1700, 1800, 1900, 2000, 2500, 3000, 4000, 5000% or more.

In one embodiment, the protein levels of endogenous RMEM in a cell are increased by methods known in the art. For example, a cell can be modified and/or treated to: (a) increase the transcription of a gene encoding endogenous RMEM; (b) increase the translation and/or processing and/or stability of endogenous RMEM mRNA; (c) increase the stability of endogenous RMEM protein; (d) increase the expression of, or activate, transcriptional activators of a gene encoding endogenous RMEM; (e) to decrease the expression, or activity, of a transcriptional repressors of a gene encoding endogenous RMEM or (f) to decrease the expression, or activity, of a post-translational repressor of the RMEM protein.

In other embodiments, a heterologous RMEM molecule is overexpressed in a cell.

RMEMs suitable for used in the present disclosure are further described herein. In one embodiment, the RMEM, in nature, or when used as described herein, mediates repair of DNA, either by directly participating in the pathways involved in DNA repair or by facilitating DNA repair. For example, the RMEM participates in any of the following DNA repair pathways: c-NHEJ, alt-NHEJ (including blunt EJ, MMEJ, and SD-MMEJ), and HDR (including alt-HR, HR, and SSA). RMEMs that facilitate DNA repair can, in nature or when used as described herein, alter chromatin or DNA structure to allow increased accessibility of the DNA for DNA repair machinery or recruitment of the DNA repair machinery, e.g., by increasing chromatin relaxation, promoting chromatin-related complex assembly, or modifying chromatin-associated proteins. Alternatively or in addition, the RMEMs can suppress a particular DNA repair process, thereby promoting a different DNA repair process. By way of example, an RMEM can promote ALT-NHEJ by suppressing canonical NHEJ.

In one embodiment, the RMEM interacts with DNA, e.g., it makes or breaks a covalent bond, e.g., cleaves a phosphodiester bond, or alters the secondary or tertiary structure of DNA, e.g., unwinds or promotes annealing of DNA. In another embodiment, the RMEM modifies a chromatin related protein, e.g., by making or breaking a covalent bond associated with the chromatin related protein, or alters the secondary, tertiary, or quaternary structure of a chromatin related protein or complex.

For example, an RMEM described herein can comprise one or more of the following activities: exonuclease activity, endonuclease activity, helicase activity, histone acetylase activity, histone deacetylase activity, histone methyltransferase activity, chromatin remodeling activity, or histone chaperone activity. In one embodiment, the RMEM plays a role in promoting any of the following activities: exonuclease activity, endonuclease activity, helicase activity, histone acetylase activity, histone deacetylase activity, histone methyltransferase activity, chromatin remodeling activity, or histone chaperone activity. Exemplary RMEMs that can be used as described herein are further described below.

In one embodiment, an RMEM, as the term is used herein, does not include CtP and Mutans, Mre11, Dna2, Fen1, Trex2, Exo1, XPG, XPF, APE-1, APLF, APTX, Artemis, Mus 81, ERCC1, WRN, BLM, RECQL4, RECQL1, XPB, XPD, FancJ/Bach1, RTEL, 53Bp1 dominant negative, VP64, Rad52, Rad51, Rad51B, Rad51C, XRCC3, Tip60/KAT5, SETD2, or INO80 complex. In one embodiment, an RMEM does not include Rad52. In one embodiment, an RMEM does not include 53BP1. In one embodiment, an RMEM does not include Rad51. In one embodiment, an RMEM does not include RPA. In one embodiment, an RMEM does not include Artemis. In one embodiment, an RMEM does not include ERCC1. In one embodiment, an RMEM does not include Rad52, 53BP1, Rad51, RPA, Artemis or ERCC1.

In another embodiment, the present disclosure provides a method of altering a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby altering the nucleic acid at the target position in the cell, or in the population of cells.

In a further embodiment, the at least one DNA repair pathway is selected from the group consisting of: canonical NHEJ, alternative NHEJ (alt-NHEJ), and HDR. In another embodiment, the at least one DNA repair pathway is canonical NHEJ. In yet another embodiment, the at least one DNA repair pathway is Alt-NHEJ. In another embodiment, the Alt-NHEJ pathway is blunt EJ, MMEJ, or SD-MMEJ. In other embodiments, the at least one DNA repair pathway is HDR. In another embodiment, the HDR repair pathway is SSA, alt-HR, or HR. In another embodiment, the frequency of ALT-NHEJ-mediated repair of the cleavage event is increased in the population of cells comprising the RMEM, as compared to the frequency of ALT-NHEJ-mediated repair of the cleavage event in a population of cells that does not comprise the RMEM. In further embodiments, the frequency of NHEJ-mediated repair of the cleavage event is increased in the population of cells comprising the RMEM, as compared to the frequency of NHEJ-mediated repair of the cleavage event in a population of cells that does not comprise the RMEM. In another embodiment, the frequency of HDR-mediated repair of the cleavage event is increased in the population of cells comprising the RMEM, as compared to the frequency of HDR-mediated repair of the cleavage event in a population of cells that does not comprise the RMEM. In yet another embodiment, the frequency of SSA-mediated repair of the cleavage event is increased in the population of cells comprising the RMEM, as compared to the frequency of SSA-mediated repair of the cleavage event in a population of cells that does not comprise the RMEM. In another embodiment, the frequency of repair is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of altering a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby altering the nucleic acid at the target position in the cell, or in the population of cells.

In another embodiment, the cleavage event is repaired gene conversion. In certain embodiments, the frequency of gene conversion is decreased in the population of cells comprising the RMEM, as compared to the frequency of gene conversion in a population of cells that does not comprise the RMEM. In other embodiments, the frequency of gene conversion is increased in the population of cells comprising the RMEM, as compared to the frequency of gene conversion in a population of cells that does not comprise the RMEM. In related embodiments, the frequency of gene conversion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the cleavage event is repaired gene correction. In certain embodiments, the frequency of gene correctionis decreased in the population of cells comprising the RMEM, as compared to the frequency of gene correction in a population of cells that does not comprise the RMEM. In other embodiments, the frequency of gene correctionis increased in the population of cells comprising the RMEM, as compared to the frequency of gene correction in a population of cells that does not comprise the RMEM. In related embodiments, the frequency of gene correctionis increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the cleavage event is repaired by a DNA repair pathway that is modulated by a RMEM to comprise a deletion. In certain embodiments, the frequency of a deletion is decreased in the population of cells comprising the RMEM, as compared to the frequency of a deletion in a population of cells that does not comprise the RMEM. In other embodiments, the frequency of a deletion is increased in the population of cells comprising the RMEM, as compared to the frequency of a deletion in a population of cells that does not comprise the RMEM. In related embodiments, the frequency of a deletion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the cleavage event is repaired by a DNA repair pathway that is modulated by a RMEM to comprise an insertion. In certain embodiments, the frequency of an insertion is decreased in the population of cells comprising the RMEM, as compared to the frequency of an insertion in a population of cells that does not comprise the RMEM. In other embodiments, the frequency of an insertion is increased in the population of cells comprising the RMEM, as compared to the frequency of an insertion in a population of cells that does not comprise the RMEM. In related embodiments, the frequency of an insertion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 16.5-fold, by about 17-fold, by about 18-fold, by about 19-fold or by about 20-fold.

Endonucleases/Exonucleases

In one embodiment, a RMEM comprises nuclease activity, e.g., cleaves the phosphodiester bond between nucleotides in a nucleic acid, e.g., DNA. The RMEM may be selected based upon its nuclease activity, e.g., cleaves at the end or in the middle of a nucleotide sequence, or its direction of activity, depending on the desired repair process, e.g., resection, ALT-NHEJ, HDR, or SSA, required to effect the genome editing event. In one embodiment, the RMEM comprises endonuclease activity, e.g., is an endonuclease. In one embodiment, the RMEM comprises exonuclease activity, e.g., is an exonuclease. In one embodiment, the RMEM comprises endonuclease and exonuclease activity, e.g., depending on the context of the microenvironment, e.g., whether a DNA strand break or overhangs are already present. Endonuclease and exonuclease activity occurs in a 5' to 3' direction, or in a 3' to 5' direction. Some endonucleases or exonucleases comprise activity in both directions. In one embodiment, the RMEM comprises an endonuclease and/or exonuclease activity, and may also comprise helicase activity.

Exemplary endonucleases and exonucleases are provided in Table 1 and are further described below.

TABLE 1

Endonucleases/Exonucleases

| Name | Sequence | SEQ ID NO: |
|---|---|---|
| Fan1 | MMSEGKPPDKKRPRRSLSISKNKKKASNSIISCFNNAPPAKLACPVCSKMVPRYDLNRHLDEMCANNDFV QVDPGQVGLINSNVSMVDLTSVTLEDVTPKKSPPPKTNLTPGQSDSAKREVKQKISPYFKSNDVVCKNQD ELRNRSVKVICLGSLASKLSRKYVKAKKSIDKDEEFAGSSPQSSKSTVVKSLIDNSSEIEDEDQILENSS QKENVFKCDSLKEECIPEHMVRGSKIMEAESQKATRECEKSALTPGFSDNAIMLFSPDFTLRNTLKSTSE DSLVKQECIKEVVEKREACHCEEVKMTVASEAKIQLSDSEAKSHSSADDASAWSNIQEAPLQDDSCLNND IPHSIPLEQGSSCNGPGQTTGHPYYLRSFLVVLKTVLENEDDMLLFDEQEKGIVTKFYQLSATGQKLYVR LFQRKLSWIKMTKLEYEEIALDLTPVIEELTNAGFLQTESELQELSEVLELLSAPELKSLAKTFHLVNPN GQKQQLVDAFLKLAKQRSVCTWGKNKPGIGAVILKRFCWLLLQ | 20 |
| Apollo | MNGVLIPHTPIAVDFWSLRRAGTARLFFLSHMHSDHTVGLSSTWARPLYCSPITAHLLHRHLQVSKQWIQ ALEVGESHVLPLDEIGQETMTVTLLDANHCPGSVMFLFEGYFGTILYTGDFRYTPSMLKEPALTLGKQIH TLYLDNTNCNPALVLPSRQEAAHQIVQLIRKHPQHNIKIGLYSLGKESLLEQLALEFQTWVVLSPRRLEL VQLLGLADVFTVEEKAGRIHAVDHMEICHSNMLRWNQTHPTIAILPTSRKIHSSHPDIHVIPYSDHSSYS ELRAFVAALKPCQVVPIVSRRPCGGFQDSLSPRISVPLIPDSVQQYMSSSSRKPSLLWLLERRLKRPRTQ GVVFESPEESADQSQADRDSKKAKKEKLSPWPADLEKQPSHHPLRIKKQLFPDLYSKEWNKAVPFCESQK RVTMLTAPLGFSVHLRSTDEEFISQKTREEIGLGSPLVPMGDDDGPEATGNQSAWMGHGSPLSHSSKGT PLLATEFRGLALKYLLTPVNFFQAGYSSRRFDQQVEKYHKPC | 21 |
| Klenox fragment of Polymerase | MVQIPQNPLILVDGSSYLYRAYHAFPPLTNSAGEPTGAMYGVLNMLRSLIMQYKPTHAAVVFDAKGKTFR DELFEHYKSHRPPMPDDLRAQIEPLHAMVKAMGLPLLAVSGVEADDVIGTLAREAEKAGRPVLISTGDKD MAQLVTPNITLINTMTNTILGPEEVVNKYGVPPELIIDFLALMGDSSDNIPGVPGVGEKTAQALLQGLGG LDTLYAEPEKIAGLSFRGAKTMAAKLEQNKEVAYLSYQLATIKTDVELELTCEQLEVQQPAAEELLGLFK KYEFKRWTADVEAGKWLQAKGAKPAAKPQETSVADEAPEVTATVISYDNYVTILDEETLKAWIAKLEKAP VFAFDTETSLDNISANLVGLSFAIEPGVAAYIPVAHDYLDAPDQISRERALELLKPLLEDEKALKVGQN LKYDRGILANYGIELRGIAFDTMLESYILNSVAGRHDMDSLAERWLKHKTITFEEIAGKGKNQLTFNQIA LEEAGRYAAEDADVTLQLHLKMWPDLQKHKGPLNVFENIEMPLVPVLSRIERNGVKIDPKVLHNHSEELT LRLAELEKKAHEIAGEEFNLSSTKQLQTILFEKQGIKPLKKTPGGAPSTSEEVLEELALDYPLPKVILEY RGLAKLKSTYTDKLPLMINPKTGRVHTSYHQAVTATGRLSSTDPNLQNIPVRNEEGRRIRQAFIAPEDYV IVSADYSQIELRIMAHLSRDKGLLTAFAEGKDIHRATAAEVFGLPLETVTSEQRRSAKAINFGLIYGMSA FGLARQLNIPRKEAQKYMDLYFERYPGVLEYMERTRAQAKEQGYVETLDGRRLYLPDIKSSNGARRAAAE RAAINAPMQGTAADIIKRAMIAVDAWLQAEQPRVRMIMQVHDELVFEVHKDDVDAVAKQIHQLMENCTRL DVPLLVEVGSGENWDQAH | 22 |
| T5 exonuclease | MSKSWGKFIEEEEAEMASRRNLMIVDGTNLGFRFKHNNSKKPFASSYVSTIQSLAKSYSARTTIVLGDKG KSVFRLEHLPEYKGNRDEKYAQRTEEEKALDEQFFEYLKDAFELCKTTFPTFTIRGVEADDMAAYIVKLI GHLYDHVWLISTDGDWDTLLTDKVSRFSFTTRREYHLRDMYEHHNVDDVEQFISLKAIMGDLGDNIRGVE GIGAKRGYNIIREFGNVLDIIDQLPLPGKQKYIQNLNASEELLFRNLILVDLPTYCVDAIAAVGQDVLDK FTKDILEIAEQ | 23 |

TABLE 1-continued

Endonucleases/Exonucleases

| Name | Sequence | SEQ ID NO: |
|---|---|---|
| Gen1 | MGVNDLWQILEPVKQHIPLRNLGGKTIAVDLSLWVCEAQTVKKMMGSVMKPHLRNLFFRISYLTQMDVKL VFVMEGEPPKLKADVISKRNQSRYGSSGKSWSQKTGRSHFKSVLRECLHMLECLGIPWVQAAGEAEAMCA YLNAGGHVDGCLTNDGDTFLYGAQTVYRNFTMNTKDPHVDCYTMSSIKSKLGLDRDALVGLAILLGCDYL PKGVPGVGKEQALKLIQILKGQSLLQRFNRWNETSCNSSPQLLVTKKLAHCSVCSHPGSPKDHERNGCRL CKSDKYCEPHDYEYCCPCEWHRTEHDRQLSEVENNIKKKACCCEGFPFHEVIQEFLLNKDKLVKVIRYQR PDLLLFQRFTLEKMEWPNHYACEKLLVLLTHYDMIERKLGSRSNQLQPIRIVKTRIRNGVHCFEIEWEK PEHYAMEDKQHGEFALLTIEEESLFEAAYPEIVAVYQKQKLEIKGKKQKRIKPKENNLPEPDEVMSFQSH MTLKPTCEIFHKQNSKLNSGISPDPTLPQESISASLNSLLLPKNTPCLNAQEQFMSSLRPLAIQQIKAVS KSLISESSQPNTSSHNISVIADLHLSTIDWEGTSFSNSPAIQRNTFSHDLKSEVESELSAIPDGFENIPE QLSCESERYTANIKKVLDEDSDGISPEEHLLSGITDLCLQDLPLKERIFTKLSYPQDNLQPDVNLKTLSI LSVKESCIANSGSDCTSHLSKDLPGIPLQNESRDSKILKGDQLLQEDYKVNTSVPYSVSNTVVKTCNVRP PNTALDHSRKVDMQTTRKILMKKSVCLDRHSSDEQSAPVFGKAKYTTQRMKHSSQKHNSSHFKESGHNKL SSPKIHIKETEQCVRSYETAENEESCFPDSTKSSLSSLQCHKKENNSGTCLDSPLPLRQRLKLRFQST | 24 |
| CtIP | MNISGSSCGSPNSADTSSDFKDLWTKLKECHDREVQGLQVKVTKLKQERILDAQRLEEFFTKNQQLREQQKVL HETIKVLEDRLRAGLCDRCAVTEEHMRKKQQEFENIRQQNLKLITELMNERNTLQEENKKLSEQLQQKIENDQ QHQAAELECEEDVIPDSPITAFSFSGVNRLRRKENPHVRYIEQTHTKLEHSVCANEMRKVSKSSTHPQHNPNE NEILVADTYDQSQSPMAKAHGTSSYTPDKSSFNLATVVAETLGLGVQEESETQGPMSPLGDELYHCLEGNHKK QPFEESTRNTEDSLRFSDSTSKTPPQEELPTRVSSPVFGATSSIKSGLDLNTSLSPSLLQPGKKKHLKTLPFS NTCISRLEKTRSKSEDSALFTHHSLGSEVNKIIIQSSNKQILINKNISESLGEQNRTEYGKDSNTDKHLEPLK SLGGGRTSKRKKTEEESEHEVSCPQASFDKENAFPFPMDNQFSMNGDCVMDKPLDLSDRFSAIQRQEKSQGSET SKNKFRQVTLYEALKTIPKGFSSSRKASDGNCTLPKDSPGEPCSQECIILQPLNKCSPDNKPSLQIKEENAVF KIPLRPRESLETENVL DDIKSAGSHEPIKIQTRSDHGGCELASVLQLNPCRTGKIKSLQNNQDVSFENIQWSIDPGADLSQYKMDVTVI DTKDGSQSKLGGETVDMDCTLVSETVLLKMKKQEQKGEKSSNEERKMNDSLEDMFDRTTHEEYESCLADSFSQ AADEEEELSTATKKLHTHGDKQDVKQKAFVEPYFKGDERETSLQNFPHIEVVRKKEERRKLLGHTCKECEIY YADMPAEEREKKLASCSRHRFRYIPPNTPENFWEVGFPSTQTCMERGYIKEDLDPCPRPKRRQPYNAIFSPKG KEQKT (CtIP-isoform 1 CCDS 11875.1) MNISGSSCGSPNSADTSSDFKDLWTKLKECHDREVQGLQVKVTKLKQERILDAQRLEEFFTKNQQLREQQKVL HETIKVLEDRLRAGLCDRCAVTEEHMRKKQQEFENIRQQNLKLITELMNERNTLQEENKKLSEQLQQKIENDQ QHQAAELECEEDVIPDSPITAFSFSGVNRLRRKENPHVRYIEQTHTKLEHSVCANEMRKVSKSSTHPQHNPNE NEILVADTYDQSQSPMAKAHGTSSYTPDKSSFNLATVVAETLGLGVQEESETQGPMSPLGDELYHCLEGNHKK QPFEESTRNTEDSLRFSDSTSKTPPQEELPTRVSSPVFGATSSIKSGLDLNTSLSPSLLQPGKKKHLKTLPFS NTCISRLEKTRSKSEDSALFTHHSLGSEVNKIIIQSSNKQILINKNISESLGEQNRTEYGKDSNTDKHLEPLK SLGGGRTSKRKKTEEESEHEVSCPQASFDKENAFPFPMDNQFSMNGDCVMDKPLDLSDRFSAIQRQEKSQGSET SKNKFRQVTLYEALKTIPKGFSSSRKASDGNCTLPKDSPGEPCSQECIILQPLNKCSPDNKPSLQIKEENAVF KIPLRPRESLETENVLDDIKSAGSHEPIKIQTRSDHGGCELASVLQLNPCRTGKIKSLQNNQDVSFENIQWSI DPGADLSQYKMDVTVIDTKDGSQSKLGGETVDMDCTLVSETVLLKMKKQEQKGEKSSNEERKMNDSLEDMFDR TTHEEYESCLADSFSQAADEEEELSTATKKLHTHGDKQDVKQKAFVEPYFKGDESIMQICQQKKEKRNWLPA QDTDSATFHPTHQRIFGKLVFLPLRLVWKEVILRKILILVLVQKDVSLTTQYFLQKARSRRHRR (CtIP-isoform 2 CCDS 11874.1) | 25 |
| Dominant Negative CtIP (S327E, T847E, or S327E + T847E) | 327, 847 MNILGSSCGSPNSADTSSDFKDLWTKLKECHDREVQGLQVKVTKLKQERILDAQRLEEFFTKNQQLREQQKVL HETIKVLEDRLRAGLCDRCAVTEEHMRKKQQEFENIRQQNLKLITELMNERNTLQEENKKLSEQLQQKIENDQ QHQAAELECEEDVIPDSPITAFSFSGVNRLRRKENPHVRYIEQTHTKLEHSVCANEMRKVSKSSTHPQHNPNE NEILVADTYDQSQSPMAKAHGTSSYTPDKSSFNLATVVAETLGLGVQEESETQGPMSPLGDELYHCLEGNHKK QPFEESTRNTEDSLRFSDSTSKTPPQEELPTRVSSPVFGATSSIKSGLDLNTSLSPSLLQPGKKKHLKTLPFS NTCISRLEKTRSKSEDSALFTHHSLGSEVNKIIIQSSNKQILINKNISESLGEQNRTEYGKDSNTDKHLEPLK SLGGGRTSKRKKTEEESEHEVSCPQASFDKENAFPFPMDNQFSMNGDCVMDKPLDLSDRFSAIQRQEKSQGSET SKNKFRQVTLYEALKTIPKGFSSSRKASDGNCTLPKDSPGEPCSQECIILQPLNKCSPDNKPSLQIKEENAVF KIPLRPRESLETENVLDDIKSAGSHEPIKIQTRSDHGGCELASVLQLNPCRTGKIKSLQNNQDVSFENIQWSI DPGADLSQYKMDVTVIDTKDGSQSKLGGETVDMDCTLVSETVLLKMKKQEQKGEKSSNEERKMNDSLEDMFDR TTHEEYESCLADSFSQAADEEEELSTATKKLHTHGDKQDVKQKAFVEPYFKGDERETSLQNFPHIEVVRKKE ERRKLLGHTCKECEIYYADMPAEEREKKLASCSRHRFRYIPPNTPENFWEVGFPSTQTCMERGYIKEDLDPCP RPKRRQPYNAIFSPKGKEQKTDYKDHDGDYKDHDI** MNISGSSCGSPNSADTSSDFKDLWTKLKECHDREVQGLQVKVTKLKQERILDAQRLEEFFTKNQQLREQQKVL HETIKVLEDRLRAGLCDRCAVTEEHMRKKQQEFENIRQQNLKLITELMNERNTLQEENKKLSEQLQQKIENDQ QHQAAELECEEDVIPDSPITAFSFSGVNRLRRKENPHVRYIEQTHTKLEHSVCANEMRKVSKSSTHPQHNPNE NEILVADTYDQSQSPMAKAHGTSSYTPDKSSFNLATVVAETLGLGVQEESETQGPMSPLGDELYHCLEGNHKK QPFEESTRNTEDSLRFSDSTSKTPPQEELPTRVSSPVFGATSSIKSGLDLNTSLSPSLLQPGKKKHLKTLPFS NTCISRLEKTRSKSEDSALFTHHSLGSEVNKIIIQSSNKQILINKNISESLGEQNRTEYGKDSNTDKHLEPLK SLGGGRTSKRKKTEEESEHEVSCPQASFDKENAFPFPMDNQFSMNGDCVMDKPLDLSDRFSAIQRQEKSQGSET SKNKFRQVTLYEALKTIPKGFSSSRKASDGNCTLPKDSPGEPCSQECIILQPLNKCSPDNKPSLQIKEENAVF | 26 |
| MRE11 | MSTADALDDENTFKILVATDIHLGFMEKDAVRGNDTFVTLDEILRLAQENEVDFILLGGDLFHENKPSRKTLH TCLELLRKYCMGDRPVQFEILSDQSVNFGFSKFPWVNYQDGNLNISIPVFSIHGNHDDPTGADALCALDILSC AGFVNHFGRSMSVEKIDISPVLLQKGSTKIALYGLGSIPDERLYRMFVNKKVTMLRPKEDENSWFNLFVIHQN RSKHGSTNFIPEQFLDDFIDLVIWGHEHECKIAPTKNEQQLFYISQPGSSVVTSLSPGEAVKKHVGLLRIKGR KMNMHKIPLHTVRQFFMEDIVLANHPDIFNPDNPKVTQAIQSFCLEKIEEMLENAERERLGNSHQPEKPLVRL RVDYSGGFEPFSVLRFSQKFVDRVANPKDIIHFFRHREQKEKTGEEINFGKLITKPSEGTTLRVEDLVKQYFQ TAEKNVQLSLLTERGMGEAVQEFVDKEEKDAIEELVKYQLEKTQRFLKERHIDALEDKIDEEVRRFRETRQKN TNEEDDEVREAMTRARALRSQSEESASAFSADDLMSIDLAEQMANDSDDSISAATNKGRGRGRGRRGGRGQNS ASRGGSQRGRAFKSTRQQPSRNVTTKNYSEVIEVDESDVEEDIFPTTSKTDQRWSSTSSSKIMSQSQVSKGVD | 27 |

TABLE 1-continued

Endonucleases/Exonucleases

| Name | Sequence | SEQ ID NO: |
|---|---|---|
| | FESSEDDDDDPFMNTSSLRRNRR (Mre11-isoform 2 CCDS 8298.1)<br>MSTADALDDENTFKILVATDIHLGFMEKDAVRGNDTFVTLDEILRLAQENEVDFILLGGDLFHENKPSRKTLH<br>TCLELLRKYCMGDRPVQFEILSDQSVNFGFSKFPWVNYQDGNLNISIPVFSIHGNHDDPTGADALCALDILSC<br>AGFVNHFGRSMSVEKIDISPVLLQKGSTKIALYGLGSIPDERLYRMFVNKKVTMLRPKEDENSWFNLFVIHQN<br>RSKHGSTNFIPEQFLDDFIDLVIWGHEHECKIAPTKNEQQLFYISQPGSSVVTSLSPGEAVKKHVGLLRIKGR<br>KMNMHKIPLHTVRQFFMEDIVLANHPDIFNPDNPKVTQAIQSFCLEKIEEMLENAERERLGNSHQPEKPLVRL<br>RVDYSGGFEPFSVLRFSQKFVDRVANPKDIIHFFRHREQKEKTGEEINFGKLITKPSEGTTLRVEDLVKQYFQ<br>TAEKNVQLSLLTERGMGEAVQEFVDKEEKDAIEELVKYQLEKTQRFLKERHIDALEDKIDEEVRRFRETRQKN<br>TNEEDDEVREAMTRARALRSQSEESASAFSADDLMSIDLAEQMANDSDDSISAATNKGRGRGRGRRGGRGQNS<br>ASRGGSQRGRADTGLETSTRSRNSKTAVSASRNMSIIDAFKSTRQQPSRNVTTKNYSEVIEVDESDVEEDIFP<br>TTSKTDQRWSSTSSSKIMSQSQVSKGVDFESSEDDDDDPFMNTSSLRRNRR (Mre11-isoform 1<br>CCDS8299.1) | |
| DNA2 | MEQLNELELLMEKSFWEEAELPAELFQKKVVASFPRTVLSTGMDNRYLVLAVNTVQNKEGNCEKRLVITASQS<br>LENKELCILRNDWCSVPVEPGDIIHLEGDCTSDTWIIDKDFGYLILYPDMLISGTSIASSIRCMRRAVLSETF<br>RSSDPATRQMLIGTVLHEVFQKAINNSFAPEKLQELAFQTIQEIRHLKEMYRLNLSQDEIKQEVEDYLPSFCK<br>WAGDFMHKNTSTDFPQMQLSLPSDNSKDNSTCNIEVVKPMDIEESIWSPRFGLKGKIDVTVGVKIHRGYKTKY<br>KIMPLELKTGKESNSIEHRSQVVLYTLLSQERRADPEAGLLLYLKTGQMYPVPANHLDKRELLKLRNQMAFSL<br>FHRISKSATRQKTQLASLPQIIEEEKTCKYCSQIGNCALYSRAVEQQMDCSSVPIVMLPKIEEETQHLKQTHL<br>EYFSLWCLMLTLESQSKDNKKNHQNIWLMPASEMEKSGSCIGNLIRMEHVKIVCDGQYLHNFQCKHGAIPVTN<br>LMAGDRVIVSGEERSLFALSRGYVKEINMTTVTCLLDRNLSVLPESTLFRLDQEEKNCDIDTPLGNLSKLMEN<br>TFVSKKLRDLIIDFREPQFISYLSSVLPHDAKDTVACILKGLNKPQRQAMKKVLLSKDYTLIVGMPGTGKTTT<br>ICTLVRILYACGFSVLLTSYTHSAVDNILLKLAKFKIGFLRLGQIQKVHPAIQQFTEQEICRSKSIKSLALLE<br>ELYNSQLIVATTCMGINHPIFSRKIFDFCIVDEASQISQPICLGPLFFSRRFVLVGDHQQLPPLVLNREARAL<br>GMSESLFKRLEQNKSAVVQLTVQYRMNSKIMSLSNKLTYEGKLECGSDKVANAVINLRHFKDVKLELEFYADY<br>SDNPWLMGVFEPNNPVCFLNTDKVPAPEQVEKGGVSNVTEAKLIVFLTSIFVKAGCSPSDIGIIAPYRQQLKI<br>INDLLARSIGMVEVNTVDKYQGRDKSIVLVSFVRSNKDGTVGELLKDWRRLNVAITRAKHKLILLGCVPSLNC<br>YPPLEKLLNHLNSEKLIIDLPSREHESLCHILGDFQRE DNA2 endonuclease (CCDS 44415.2) | 28 |
| FEN1 | MGIQGLAKLIADVAPSAIRENDIKSYFGRKVAIDASMSIYQFLIAVRQGGDVLQNEEGET<br>TSHLMGMFYRTIRMMENGIKPVYVFDGKPPQLKSGELAKRSERRAEAEKQLQQAQAAGAE<br>QEVEKFTKRLVKVTKQHNDECKHLLSLMGIPYLDAPSEAEASCAALVKAGKVYAAATEDM<br>DCLTFGSPVLMRHLTASEAKKLPIQEFHLSRILQELGLNQEQFVDLCILLGSDYCESIRG<br>IGPKRAVDLIQKHKSIEEIVRRLDPNKYPVPENWLHKEAHQLFLEPEVLDPESVELKWSE<br>PNEEELIKFMCGEKQFSEERIRSGVKRLSKSRQGSTQGRLDDFFKVTGSLSSAKRKEPEP<br>KGSTKKKAKTGAAGKFKRGK (Fen1 CCDS 8010.1) | 29 |
| Mus81 | MAAPVRLGRKRPLPACPNPLFVRWLTEWRDEATRSRRRTRFVFQKALRSLRRYPLPLRSGKEAKILQHFG<br>DGLCRMLDERLQRHRTSGGDHAPDSPSGENSPAPQGRLAEVQDSSMPVPAQPKAGGSGSYWPARHSGARV<br>ILLVLYREHLNPNGHHFLTKEELLQRCAQKSPRVAPGSARPWPALRSLLHRNLVLRTHQPARYSLTPEGL<br>ELAQKLAESEGLSLLNVGIGPKEPPGEETAVPGAASAELASEAGVQQQPLELRPGEYRVLLCVDIGETRG<br>GGHRPELLRELQRLHVTHTVRKLHVGDFVWVAQETNPRDPANPGELVLDHIVERKRLDDLCSSIIDGRFR<br>EQKFRLKRCGLERRVYLVEEHGSVHNLSLPESTLLQAVTNTQVIDGFFVKRTADIKESAAYLALLTRGLQ<br>RLYQGHTLRSRPWGTPGNPESGAMTSPNPLCSLLTFSDFNAGAIKNKAQSVREVFARQLMQVRGVSGEKA<br>AALVDRYSTPASLLAAYDACATPKEQETLLSTIKCGRLQRNLGPALSRTLSQLYCSYGPLT (MUS81<br>endonuclease homolog (yeast), isoform CRA_b [Homo sapiens], CCDS 8115.1) | 30 |
| TREX2 | MSEAPRAETFVFLDLEATGLPSVEPEIAELSLFAVHRSSLENPEHDESGALVLPRVLDKLTLCMCPERPF<br>TAKASEITGLSSEGLARCRKAGFDGAVVRTLQAFLSRQAGPICLVAHNGFDYDFPLLCAELRRLGARLPR<br>DTVCLDTLPALRGLDRAHSHGTRARGRQGYSLGSLFHRYFRAEPSAAHSAEGDVHTLLLIFLHRAAELLA<br>WADAEQARGWAHIEPMYLPPDDPSLEA|NP_542432.2|three prime repair exonuclease 2<br>[Homo sapiens] | 31 |
| EXO1 | MGIQGLLQFIKEASEPIHVRKYKGQVVAVDTYCWLHKGAIACAEKLAKGEPTDRYVGFCM<br>KFVNMLLSHGIKPILVFDGCTLPSKKEVERSRRERRQANLLKGKQLLREGKVSEARECFT<br>RSINITHAMAHKVIKAARSQGVDCLVAPYEADAQLAYLNKAGIVQAIITEDSDLLAFGCK<br>KVILKMDQFGNGLEIDQARLGMCRQLGDVFTEEKFRYMCILSGCDYLSSLRGIGLAKACK<br>VLRLANNPDIVKVIKKIGHYLKMNITVPEDYINGFIRANNTFLYQLVFDPIKRKLIPLNA<br>YEDDVDPETLSYAGQYVDDSIALQIALGNKDINTFEQIDDYNPDTAMPAHSRSHSWDDKT<br>CQKSANVSSIWHRNYSPRPESGTVSDAPQLKENPSTVGVERVISTKGLNLPRKSSIVKRP<br>RSAELSEDDLLSQYSLSFTKKTKKNSSEGNKSLSFSEVFVPDLVNGPTNKKSVSTPPRTR<br>NKFATFLQRKNEESGAVVVPGTRSRFFCSSDSTDCVSNKVSIQPLDETAVTDKENNLHES<br>EYGDQEGKRLVDTDVARNSSDDIPNNHIPGDHIPDKATVFTDEESYSFESSKFTRTISPP<br>TLGTLRSCFSWSGGLGDFSRTPSPSPSTALQQFRRKSDSPTSLPENNMSDVSQLKSEESS<br>DDESHPLREEACSSQSQESGEFSLQSSNASKLSQCSSKSDSEESDCNIKLLDSQSDQTS<br>KLRLSHFSKKDTPLRNKVPGLYKSSSADSLSTTKIKPLGPARASGLSKKPASIQKRKHHN<br>AENKPGLQIKLNELWKNFGFKKF (Exo1 Isoform 1 CCDS 44336.1)<br>MGIQGLLQFIKEASEPIHVRKYKGQVVAVDTYCWLHKGAIACAEKLAKGEPTDRYVGFCM<br>KFVNMLLSHGIKPILVFDGCTLPSKKEVERSRRERRQANLLKGKQLLREGKVSEARECFT<br>RSINITHAMAHKVIKAARSQGVDCLVAPYEADAQLAYLNKAGIVQAIITEDSDLLAFGCK<br>KVILKMDQFGNGLEIDQARLGMCRQLGDVFTEEKFRYMCILSGCDYLSSLRGIGLAKACK<br>VLRLANNPDIVKVIKKIGHYLKMNITVPEDYINGFIRANNTFLYQLVFDPIKRKLIPLNA<br>YEDDVDPETLSYAGQYVDDSIALQIALGNKDINTFEQIDDYNPDTAMPAHSRSHSWDDKT<br>CQKSANVSSIWHRNYSPRPESGTVSDAPQLKENPSTVGVERVISTKGLNLPRKSSIVKRP | 32 |

TABLE 1-continued

Endonucleases/Exonucleases

| Name | Sequence | SEQ ID NO: |
|---|---|---|
| | RSAELSEDDLLSQYSLSFTKKTKKNSSEGNKSLSFSEVFVPDLVNGPTNKKSVSTPPRTR NKFATFLQRKNEESGAVVVPGTRSRFFCSSDSTDCVSNKVSIQPLDETAVTDKENNLHES EYGDQEGKRLVDTDVARNSSDDIPNNHIPGDHIPDKATVFTDEESYSFESSKFTRTISPP TLGTLRSCFSWSGGLGDFSRTPSPSPSTALQQFRRKSDSPTSLPENNMSDVSQLKSEESS DDESHPLREEACSSQSQESGEFSLQSSNASKLSQCSSKDSDSEESDCNIKLLDSQSDQTS KLRLSHFSKKDTPLRNKVPGLYKSSSADSLSTTKIKPLGPARASGLSKKPASIQKRKHHN AENKPGLQIKLNELWKNFGFKKDSEKLPPCKKPLSPVRDNIQLTPEAEEDIFNKPECGRV QRAIFQ (Exo1 Isoform 2 CCDS 1620.1) | |
| XPG | MGVQGLWKLLECSGRQVSPEALEGKILAVDISIWLNQALKGVRDRHGNSIENPHLLTLFH RLCKLLFFRIRPIFVFDGDAPLLKKQTLVKRRQRKDLASSDSRKTTEKLLKTFLKRQAIK TAFRSKRDEALPSLTQVRRENDLYVLPPLQEEEKHSSEEEDEKEWQERMNQKQALQEEFF HNPQAIDIESEDFSSLPPEVKHEILTDMKEFTKRRRTLFEAMPEESDDFSQYQLKGLLKK NYLNQHIEHVQKEMNQQHSGHIRRQYEDEGGFLKEVESRRVVSEDTSHYILIKGIQAKTV AEVDSESLPSSSKMHGMSFDVKSSPCEKLKTEKEPDATPPSPRTLLAMQAALLGSSSEEE LESENRRQARGRNAPAAVDEGSISPRTLSAIKRALDDDEDVKVCAGDDVQTGGPGAEEMR INSSTENSDEGLKVRDGKGIPPFTATLASSSVNSAEEHVASTNEGREPTDSVPKEQMSLVH VGTEAFPISDESMIKDRKDRLPLESAVVRHSDAPGLPNGRELTPASPTCTNSVSKNETHA EVLEQQNELCPYESKFDSSLLSSDDETKCKPNSASEVIGPVSLQETSSIVSVPSEAVDNV ENVVSFNAKEHENFLETIQEQQTTESAGQDLISIPKAVEPMEIDSEEESESDGSFIEVQSV ISDEELQAEFPETSKPPSEQGEEELVGTREGEAPAESESLLRDNSERDDVDGEPQEAEKD AEDSLHEWQDINLEELETLESNLLAQQNSLKAQKQQQERIAATVTGQMFLESQELLRLFG IPYIQAPMEAEAQCAILDLTDQTSGTITDDSDIWLFGARHVYRNFFNKNKFVEYYQYVDF HNQLGLDRNKLINLAYLLGSDYTEGIPTVGCVTAMEILNEFPGHGLEPLLKFSEWWHEAQ KNPKIRPNPHDTKVKKKLRTLQLTPGFPNPAVAEAYLKPVVDDSKGSFLWGKPDLDKIRE FCQRYFGWNRTKTDESLFPVLKQLDAQQTQLRIDSFFRLAQQEKEDAKRIKSQRLNRAVT CMLRKEKEAAASEIEAVSVAMEKEFELLDKAKGKTQKRGITNTLEESSSLKRKRLSDSKG KNTCGGFLGETCLSESSDGSSSEDAESSSLMNVQRRTAAKEPKTSASDSQNSVKEAPVKN GGATTSSSSDSDDDGGKEKMVLVTARSVFGKKRRKLRRARGRKRKT (XPG CCDS 32004.1) | 33 |
| XPF | MESGQPARRIAMAPLLEYERQLVLELLDTDGLVVCARGLGADRLLYHFLQLHCHPACLVL VLNTQPAEEEYFINQLKIEGVEHLPRRVTNEITSNSRYEVYTQGGVIFATSRILVVDFLT DRIPSDLITGILVYRAHRIIESCQEAFILRLFRQKNKRGFIKAFTDNAVAFDTGFCHVER VMRNLFVRKLYLWPRFHVAVNSFLEQHKPEVVEIHVSMTPTMLAIQTAILDILNACLKEL KCHNPSLEVEDLSLENAIGKPFDKTIRHYLDPLWHQLGAKTKSLVQDLKILRTLLQYLSQ YDCVTFLNLLESLRATEKAFGQNSGWLFLDSSTSMFINARARVYHLPDAKMSKKEKISEK MEIKEGEETKKELVLESNPKWEALTEVLKEIEAENKESEALGGPGQVLICASDDRTCSQL RDYITLGAEAFLLRLYRKTFEKDSKAEEVWMKFRKEDSSKRIRKSHKRPKDPQNKERAST KERTLKKKKRKLTLTQMVGKPEELEEEGDVEEGYRREISSSPESCPEEIKHEEFDVNLSS DAAFGILKEPLTIIHPLLGCSDPYALTRVLHESVEPRYVVLYDAELTFVRQLEIYRASRPG KPLRVYFLIYGGSTEEQRYLTALRKEKEAFEKLIREKASMVVPEEREGRDETNLDLVRGT ASADVSTDTRKAGGGEQNGTQQSIVVDMREFRSELPSLIHRRGIDIEPVTLEVGDYILTP EMCVERKSISDLIGSLNNGRLYSQCISMSRYYKRPVLLIEFDPSKPFSLTSRGALFQEIS SNDISSKLTLLTLHFPRLRILWCPSPHATAELFEELKQSKPQPDAATALAITADSETLPE SEKYNPGPQDFLLKMPGVNAKNCRSLMHHVKNIAELAALSQDELTSILGNAANAKQLYDF IHTSFAEVVSKGKGKK (XPF CCDS 32390.1) | 34 |
| APE1 | MPKRGKKGAVAEDGDELRTEPEAKKSKTAAKKNDKEAAGEGPALYEDPPDQKTSPSGKPA TLKICSWNVDGLRAWIKKKGLDWVKEEAPDILCLQETKCSENKLPAELQELPGLSHQYWS APSDKEGYSGVGLLSRQCPLKVSYGIGDEEHDQEGRVIVAEFDSFVLVTAYVPNAGRGLV RLEYRQRWDEAFRKFLKGLASRKPLVLCGDLNVAHEEIDLRNPKGNKKNAGFTPQERQGF GELLQAVPLADSFRHLYPNTPYAYTFWTYMMNARSKNVGWRLDYFLLSHSLLPALCDSKI RSKALGSDHCPITLYLAL (APE-1 CCDS 9550.1) | 35 |
| APTX | MMRVCWLVRQDSRHQRIRLPHLEAVVIGRGPETKITDKKCSRQQVQLKAECNKGYVKVKQ VGVNPTSIDSVVIGKDQEVKLQPGQVLHMVNELYPYIVEFEEEAKNPGLETHRKRKRSGN SDSIERDAAQEAEAGTGLEPGSNSGQCSVPLKKGKDAPIKKESLGHWSQGLKISMQDPKM QVYKDEQVVVIKDKYPKARYHWLVLPWTSISSSLKAVAREHLELLKHMHTVGEKVIVDFAG SSKLRFRLGYHAIPSMSHVHLHVISQDFDSPCLKNKKHWNSFNTEYFLESQAVIEMVQEA GRVTVRDGMPELLKLPLRCHECQQLLPSIPQLKEHLRKHWTQ (APTX Isoform 1 CCDS 47956.1)<br>MSNVNLSVSDFWRVMMRVCWLVRQDSRHQRIRLPHLEAVVIGRGPETKITDKKCSRQQEF EEEAKNPGLETHRKRKRSGNSDSIERDAAQEAEAGTGLEPGSNSGQCSVPLKKGKDAPIK KESLGHWSQGLKISMQDPKMQVYKDEQVVVIKDKYPKARYHWLVLPWTSISSSLKAVAREH LELLKHMHTVGEKVIVDFAGSSKLRFRLGYHAIPSMSHVHLHVISQDFDSPCLKNKKHWN SFNTEYFLESQAVIEMVQEAGRVTVRDGMPELLKLPLRCHECQQLLPSIPQLKEHLRKHW TQ (APTX Isoform 2 CCDS 56568.1)<br>MMRVCWLVRQDSRHQRIRLPHLEAVVIGRGPETKITDKKCSRQQEFEEEAKNPGLETHRK RKRSGNSDSIERDAAQEAEAGTGLEPGSNSGQCSVPLKKGKDAPIKKESLGHWSQGLKIS MQDPKMQVYKDEQVVVIKDKYPKARYHWLVLPWTSISSSLKAVAREHLELLKHMHTVGEKV IVDFAGSSKLRFRLGYHAIPSMSHVHLHVISQDFDSPCLKNKKHWNSFNTEYFLESQAVI EMVQEAGRVTVRDGMPELLKLPLRCHECQQLLPSIPQLKEHLRKHWTQ (APTX Isoform 3 CCDS 75827.1) | 36 |

TABLE 1-continued

Endonucleases/Exonucleases

| Name | Sequence | SEQ ID NO: |
|---|---|---|
| APLF | MSGGFELQPRDGGPRVALAPGETVIGRGPLLGITDKRVSRRHAILEVAGGQLRIKPIHTN<br>PCFYQSSEKSQLLPLKPNLWCYLNPGDSFSLLVDKYIFRILSIPSEVEMQCTLRNSQVLD<br>EDNILNETPKSPVINLPHETTGASQLEGSTEIAKTQMTPTNSVSFLGENRDCNKQQPILA<br>ERKRILPTWMLAEHLSDQNLSVPAISGGNVIQGSGKEEICKDKSQLNTTQQGRRQLISSG<br>SSENTSAEQDTGEECKNTDQEESTISSKEMPQSFSAITLSNTEMNNIKTNAQRNKLPIEE<br>LGKVSKHKIATKRTPHKEDEAMSCSENCSSAQGDSLQDESQGSHSESSSNPSNPETLHAK<br>ATDSVLQGSEGNKVKRTSCMYGANCYRKNPVHFQHFSHPGDSDYGGVQIVGQDETDDRPE<br>CPYGPSCYRKNPQHKIEYRHNTLPVRNVLDEDNDNVGQPNEYDLNDSFLDDEEEDYEPTD<br>EDSDWEPGKEDEEKEDVEELLKEAKRFMKRK (APLF CCDS 1888.1) | 37 |
| ARTEMIS | MSSFEGQMAEYPTISIDRFDRENLRARAYFLSHCHKDHMKGLRAPTLKRRLECSLKVYLY<br>CSPVTKELLLTSPKYRFWKKRIISIEIETPTQISLVDEASGEKEEIVVTLLPAGHCPGSV<br>MFLFQGNNGTVLYTGDFRLAQGEAARMELLHSGGRVKDIQSVYLDTTFCDPRFYQIPSRE<br>ECLSGVLELVRSWITRSPYHVVWLNCKAAYGYEYLFTNLSEELGVQVHVNKLDMFRNMPE<br>ILHHLTTDRNTQIHACRHPKAEEYFQWSKLPCGITSRNRIPLHIISIKPSTMWFGERSRK<br>TNVIVRTGESSYRACFSFHSSYSEIKDFLSYLCPVNAYPNVIPVGTTMDKVVEILKPLCR<br>SSQSTEPKYKPLGKLKRARTVHRDSEEEDDYLFDDPLPIPLRHKVPYPETFHPEVFSMTA<br>VSEKQPEKLRQTPGCCRAECMQSSRFTNFVDCEESNSESEEEVGIPASLQGDLGSVLHLQ<br>KADGDVPQWEVFFKRNDEITDESLENFPSSTVAGGSQSPKLFSDSDGESTHISSQNSSQS<br>THITEQGSQGWDSQSDTVLLSSQERNSGDITSLDKADYRPTIKENIPASLMEQNVICPKD<br>TYSDLKSRDKDVTIVPSTGEPTTLSSETHIPEEKSLLNLSTNADSQSSSDFEVPSTPEAE<br>LPKREHLQYLYEKLATGESIAVKKRKCSLLDT (Artemis Isoform 1 CCDS 31149.1)<br>MKHQERFLFQGNNGTVLYTGDFRLAQGEAARMELLHSGGRVKDIQSVYLDTTFCDPRFYQ<br>IPSREECLSGVLELVRSWITRSPYHVVWLNCKAAYGYEYLFTNLSEELGVQVHVNKLDMF<br>RNMPEILHHLTTDRNTQIHACRHPKAEEYFQWSKLPCGITSRNRIPLHIISIKPSTMWFG<br>ERSRKTNVIVRTGESSYRACFSFHSSYSEIKDFLSYLCPVNAYPNVIPVGTTMDKVVEIL<br>KPLCRSSQSTEPKYKPLGKLKRARTVHRDSEEEDDYLFDDPLPIPLRHKVPYPETFHPEV<br>FSMTAVSEKQPEKLRQTPGCCRAECMQSSRFTNFVDCEESNSESEEEVGIPASLQGDLGS<br>VLHLQKADGDVPQWEVFFKRNDEITDESLENFPSSTVAGGSQSPKLFSDSDGESTHISSQ<br>NSSQSTHITEQGSQGWDSQSDTVLLSSQERNSGDITSLDKADYRPTIKENIPASLMEQNV<br>ICPKDTYSDLKSRDKDVTIVPSTGEPTTLSSETHIPEEKSLLNLSTNADSQSSSDFEVPS<br>TPEAELPKREHLQYLYEKLATGESIAVKKRKCSLLDT (Artemis Isoform 2 CCDS 7105.1)<br>MFLFQGNNGTVLYTGDFRLAQGEAARMELLHSGGRVKDIQSVYLDTTFCDPRFYQIPSRE<br>ECLSGVLELVRSWITRSPYHVVWLNCKAAYGYEYLFTNLSEELGVQVHVNKLDMFRNMPE<br>ILHHLTTDRNTQIHACRHPKAEEYFQWSKLPCGITSRNRIPLHIISIKPSTMWFGERSRK<br>TNVIVRTGESSYRACFSFHSSYSEIKDFLSYLCPVNAYPNVIPVGTTMDKVVEILKPLCR<br>SSQSTEPKYKPLGKLKRARTVHRDSEEEDDYLFDDPLPIPLRHKVPYPETFHPEVFSMTA<br>VSEKQPEKLRQTPGCCRAECMQSSRFTNFVDCEESNSESEEEVGIPASLQGDLGSVLHLQ<br>KADGDVPQWEVFFKRNDEITDESLENFPSSTVAGGSQSPKLFSDSDGESTHISSQNSSQS<br>THITEQGSQGWDSQSDTVLLSSQERNSGDITSLDKADYRPTIKENIPASLMEQNVICPKD<br>TYSDLKSRDKDVTIVPSTGEPTTLSSETHIPEEKSLLNLSTNADSQSSSDFEVPSTPEAE<br>LPKREHLQYLYEKLATGESIAVKKRKCSLLDT (Artemis Isoform 3 CCDS 31150.1) | 38 |
| ERCC1 | >sp\|P07992\|ERCC1_HUMAN DNA excision repair protein<br>ERCC-1 OS = Homo sapiens GN = ERCC1 PE = 1 SV = 1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP<br>WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRVTECLT<br>TVKSVNKTDSQTLLTTFGSLEQLIAASREDLALCPGLGPQKARRLFDVLHEPFLKVP<br>>sp\|P07992-2\|ERCC1_HUMAN Isoform 2 of DNA excision<br>repair protein ERCC-1 OS = Homo sapiens GN = ERCC1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP<br>WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRSLEQLI<br>AASREDLALCPGLGPQKARRLFDVLHEPFLKVP<br>>sp\|P07992-3\|ERCC1_HUMAN Isoform 3 of DNA excision<br>repair protein ERCC-1 OS = Homo sapiens GN = ERCC1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP<br>WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRVTECLT<br>TVKSVNKTDSQTLLTTFGSLEQLIAASREDLALCPGLGPQKVRALGKNPRSWGKERAPNK<br>HNLRPQSFKVKKEPKTRHSGFRL<br>>sp\|P07992-4\|ERCC1_HUMAN Isoform 4 of DNA excision<br>repair protein ERCC-1 OS = Homo sapiens GN = ERCC1<br>MDPGKDKEGVPQPSGPPARKKFVIPLDEDEVPPGVRGNPVLKFVRNVPWEFGDVIPDYVL<br>GQSTCALFLSLRYHNLHPDYIHGRLQSLGKNFALRVLLVQVDVKDPQQALKELAKMCILA<br>DCTLILAWSPEEAGRYLETYKAYEQKPADLLMEKLEQDFVSRVTECLTTVKSVNKTDSQT<br>LLTTFGSLEQLIAASREDLALCPGLGPQKARRLFDVLHEPFLKVP | 39 |

In one embodiment, the RMEM is Fan 1, Apollo, Klenox fragment of polymerase, T5 exonuclease, or Gen1. In one embodiment, the RMEM is not CtP and mutans, Mre11, Dna2, Fen1, Trex2, Exo1, XPG, XPF, APE-1, APLF, APTX, Artemis, ERCC1 or Mus81. In another embodiment, the RMEM is not an exonuclease. In another embodiment, the RMEM is not an endonuclease. In one embodiment, the RMEM is not Artemis.

In another embodiment, the present disclosure provides a method of enhancing the formation of a deletion in a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Artemis, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby enhancing the formation of a deletion in the nucleic acid at the target position in the cell, or in the population of cells. In one embodiment, the formation of a deletion in a nucleic acid at a target position in a cell, or a population of cells is enhanced or increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene correction of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is T5 exonuclease, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing gene correction of the nucleic acid at the target position in the cell, or in the population of cells. In one embodiment, gene correction is suppressed by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing the formation of an insertion in a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is T5 exonuclease, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing formation of an insertion in the nucleic acid at the target position in the cell, or in the population of cells. In one embodiment, the formation of an insertion in a nucleic acid at a target position in a cell, or a population of cells is enhanced or increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

Helicases

In one embodiment, a RMEM comprises helicase activity, e.g., is a helicase. The RMEM may be selected based upon its activity, e.g., unwinding or annealing of DNA, or its direction of activity, e.g., 5' to 3' or 3' to 5', depending on the desired repair process, e.g., c-NHEJ, alt-NHEJ (including blunt EJ, MMEJ, and SD-MMEJ), and/or HDR (including alt-HR, HR, and SSA), required to effect the genome editing event. Helicases are motor proteins that move along the backbone of the DNA and alter the structure of DNA by unwinding DNA or promoting the annealing of single strands. Unwinding of the DNA occurs through an ATP-dependent process that breaks the hydrogen bonds between the nucleotides of annealed strands, e.g., through ATP hydrolysis. Unwinding activity can occur in the 5' to 3' direction or in the 3' to 5' direction. Helicase activity also includes promoting ATP-independent or ATP-dependent annealing of two single strands with significant or sufficient complementarity. Helicases are classified into 6 groups based on motifs and consensus sequences shared by the molecules. The two largest families are Superfamily 1 (SF1) and Superfamily 2 (SF2), in which the members of both families form a ring structure. SF1 is further subdivided into SF1A and SF1B helicases, and can have 5' to 3' or 3' to 5' directionality. SF2 is the largest group and is characterized by the presence of conserved motifs: Q, I, Ia, Ib, II, III and IV. This group includes the RecQ family and Snf2-like enzymes. The 4 other families are Superfamily 3 (SF3; encoded mainly by small DNA viruses); Superfamily 4 (SF4; characterized by 5' to 3' directionality); Superfamily 5 (SF5; Rho proteins); and Superfamily 6 (SF6; contain core AAA+ domains).

Exemplary helicases are provided in Table 2 below and are further described below.

TABLE 2

Helicases

| Name | Directional activity | Sequence | SEQ ID NO: |
|---|---|---|---|
| Pif1 Isoform 1 CCDS 10195.2 | promotes strand annealing | MLSGIEAAAGEYEDSELRCRVAVEELSPGGQPRRRQALRTAELSLGRNERRELMLRLQAP GPAGRPRCFPLRAARLFTRFAEAGRSTLRLPAHDTPGAGAVQLLLSDCPPDRLRRFLRTL RLKLAAAPGPGPASARAQLLGPRPRDFVTISPVQPEERRLRAATRVPDTTLVKRPVEPQA GAEPSTEAPRWPLPVKRLSLPSTKPQLSEEQAAVLRAVLKGQSIFFTGSAGTGKSYLLKR ILGSLPPTGTVATASTGVAACHIGGTTLHAFAGIGSGQAPLAQCVALAQRPGVRQGWLNC QRLVIDEISMVEADLFDKLEAVARAVRQQNKPFGGIQLIICGDFLQLPPVTKGSQPPRFC FQSKSWKRCVPVTLELTKVWRQADQTFISLLQAVRLGRCSDEVTRQLQATASHKVGRDGI VATRLCTHQDDVALTNERRLQELPGKVHRFEAMDSNPELASTLDAQCPVSQLLQLKLGAQ VMLVKNLSVSRGLVNGARGVVVGFEAEGRGLPQVRFLCGVTEVIHADRWTVQATGGQLLS RQQLPLQLAWAMSIHKSQGMTLDCVEISLGRVFASGQAYVALSRARSLQGLRVLDFDPMA VRCDPRVLHFYATLRRGRSLSLESPDDDEAASDQENMDPIL | 40 |
| Pif1 Isoform 2 CCDS 66797.1 | | MLSGIEAAAGEYEDSELRCRVAVEELSPGGQPRRRQALRTAELSLGRNERRELMLRLQAP GPAGRPRCFPLRAARLFTRFAEAGRSTLRLPAHDTPGAGAVQLLLSDCPPDRLRRFLRTL RLKLAAAPGPGPASARAQLLGPRPRDFVTISPVQPEERRLRAATRVPDTTLVKRPVEPQA GAEPSTEAPRWPLPVKRLSLPSTKPQLSEEQAAVLRAVLKGQSIFFTGSAGTGKSYLLKR ILGSLPPTGTVATASTGVAACHIGGTTLHAFAGIGSGQAPLAQCVALAQRPGVRQGWLNC QRLVIDEISMVEADLFDKLEAVARAVRQQNKPFGGIQLIICGDFLQLPPVTKGSQPPRFC FQSKSWKRCVPVTLELTKVWRQADQTFISLLQAVRLGRCSDEVTRQLQATASHKVGRDGI VATRLCTHQDDVALTNERRLQELPGKVHRFEAMDSNPELASTLDAQCPVSQLLQLKLGAQ VMLVKNLSVSRGLVNGARGVVVGFEAEGRGLPQVRFLCGVTEVIHADRWTVQATGGQLLS RQQLPLQLAWAMSIHKSQGMTLDCVEISLGRVFASGQAYVALSRARSLQGLRVLDFDPMA VRCDPRVLHFYATLRRGRSLSLAAEGRGNEDRCSGSSIRALGGDWWGLRLGAASKQRTEL RCVSTARPSLAQPRTNTLQSLTKEHKLQNVHPYFKLLFQGINSVWGH | 41 |
| HARP/ SMARCAL1 CCDS 2403.1 | promotes strand annealing | MSLPLTEEQRKKIEENRQKALARRAEKLLAEQHQRTSSGTSIAGNPFQAKQGPSQNFPRE SCKPVSHGVIFKQQNLSSSNADQRPHDSHSFQAKGIWKKPEEMPTACPGHSPRSQMALT GISPPLAQSPPEVPKQQLLSYELGQGHAQASPEIRFTPFANPTHKPLAKPKSSQETPAHS SGQPPRDAKLEAKTAKASPSGQNISYIHSSSESVTPRTEGRLQQKSGSSVQKGVNSQKGK CVRNGDREQVLIGYNAELIAVEKTLPSKNYDPDTKTWNFSMNDYSALMKAAQSLPTVNLQ PLEWAYGSSESPSTSSEGQAGLPSAPSLSFVKGRCMLISRAYFEADISYSQDLIALFKQM DSRRYDVKTRKWSFLLEEHSKLIAKVRCLPQVQLDPLPTTLTLAFASQLKKTSLSLTPDV PEADLSEVDPKLVSNLMPFQRAGVNFAIAKGGRLLLADDMGLGKTIQAICIAAFYRKEWP LLVVVPSSVRFTWEQAFLRWLPSLSPDCINVVVTGKDRLTAGLINIVSFDLLSKLEKQLK TPFKVVIIDESHFLKNSRTARCRAAMPVLKVAKRVILLSGTPAMSRPAELYTQIIAVKPT FFPQFHAFGLRYCDAKRMPWGWDYSGSSNLGELKLLLEEAVMLRRLKSDVLSQLPAKQRK IVVIAPGRINARTRAALDAAAKEMTTKDKTKQQQKDALILFFNRTAEAKIPSVIEYILDL LESGREKPLVFAHHKVVLDAITQELERKHVQHIRIDGSTSSAEREDLCQQFQLSERHAVA VLSITAANMGLTFSSADLVVFAELFWNPGVLIQAEDRVHRIGQTSSVGIHYLVAKGTADD YLWPLIQEKIKVLAEAGLSETNFSEMTESTDYLYKDPKQQKIYDLFQKSFEKEGSDMELL EAAESFDPGSASGTGSSSQNMGDTLDESSLTASPQKKRRFEFFDNWDSFTSPL | 42 |
| ZRANB3 Isoform 1 CCDS 46419.1 | promotes strand annealing | MPRVHNIKKSLTPHISCVTNESDNLLDFLPDRLRAKLLPFQKDGIIFALKRNGRCMVADE MGLGKTIQAIGITYFYKEEWPLLIVVPSSLRYPWTEEIEKWIPELSPEEINVIQNKTDVR RMSTSKVTVLGYGLLTADAKTLIDALNNQNFKVVIVDESHYMKSRNATRSRILLPIVQKA RRAILLTGTPALGRPEELFMQIEALFPQKFGRWTDYAKRYCNAHIRYFGKRPQWDCRGAS NLNELHQLLSDIMIRRLKTEVLTQLPPKVRQRIPFDLPSAAAKELNTSFEEWEKIMRTPN SGAMETVMGLITRMFKQTAIAKAGAVKDYIKMMLQNDSLKFLVFAHHLSMLQACTEAVIE NKTRYIRIDGSVSSSERIHLVNQFQKDPDTRVAILSIQAAGQGLTFTAASHVVFAELYWD PGHIKQAEDRAHRIGQCSSVNIHYLIANGTLDTLMWGMLNRKAQVTGSTLNGRKEKIQAE EGDKEKWDFLQFAEAWTPNDSSEELRKEALFTHFEKEKQHDIRSFFVPQPKKRQLMTSCD ESKRFREENTVVSSDPTKTAARDIIDYESDVEPETKRLKLAASEDHCSPSEETPSQSKQI RTPLVESVQEAKAQLTTPAFPVEGWQCSLCTYINNSELPYCEMCETPQGSAVMQIDSLNH IQDKNEKDDSQKDTSKKVQTISDCEKQALAQSEPGQLADSKEETPKIEKEDGLTSQPGNE QWKSSDTLPVYDTLMFCASRNTDRIHIYTKDGKQMSCNFIPLDIKLDLWEDLPASFQLKQ YRSLILRFVREWSSLTAMKQRIIRKSGQLFCSPILALEEITKQQTKQNCTKRYITKEDVA VASMDKVKNVGGHVRLITKESRPRDPFTKKLLEDGACVPFLNPYTVQADLTVKPSTSKGY LQAVDNEGNPLCLRCQQPTCQTKQACKANSWDSRFCSLKCQEEFWIRSNNSYLRAKVFET EHGVCQLCNVNAQELFLRLRDAPKSQRKNLLYATWTSKLPLEQLNEMIRNPGEGHFWQVD HIKPVYGGGGQCSLDNLQTLCTVCHKERTARQAKERSQVRRQSLASKHGSDITRFLVKK | 43 |
| ZRANB3 Isoform 2 | | MPRVHNIKKSLTPHISCVTNESDNLLDFLPDRLRAKLLPFQKDGIIFALKRNGRCMVADE MGLGKTIQAIGITYFYKEEWPLLIVVPSSLRYPWTEEIEKWIPELSPEEINVIQNKTDVR RMSTSKVTVLGYGLLTADAKTLIDALNNQNFKVVIVDESHYMKSRNATRSRILLPIVQKA RRAILLTGTPALGRPEELFMQIEALFPQKFGRWTDYAKRYCNAHIRYFGKRPQWDCRGAS NLNELHQLLSDIMIRRLKTEVLTQLPPKVRQRIPFDLPSAAAKELNTSFEEWEKIMRTPN SGAMETVMGLITRMFKQTAIAKAGAVKDYIKMMLQNDSLKFLVFAHHLSMLQACTEAVIE NKTRYIRIDGSVSSSERIHLVNQFQKDPDTRVAILSIQAAGQGLTFTAASHVVFAELYWD PGHIKQAEDRAHRIGQCSSVNIHYLIANGTLDTLMWGMLNRKAQVTGSTLNGRKEKIQAE EGDKEKWDFLQFAEAWTPNDSSEELRKEALFTHFEKEKQHDIRSFFVPQPKKRQLMTSCD ESKRFREENTVVSSDPTKTAARDIIDYESDVEPETKRLKLAASEDHCSPSEETPSQSKQI RTPLVESVQEAKAQLTTPAFPVEGWQCSLCTYINNSELPYCEMCETPQGSAVMQIDSLNH IQDKNEKDDSQKDTSKKVQTISDCEKQALAQSEPGQLADSKEETPKIEKEDGLTSQPEQW KSSDTLPVYDTLMFCASRNTDRIHIYTKDGKQMSCNFIPLDIKLDLWEDLPASFQLKQYR | 44 |

TABLE 2-continued

Helicases

| Name | Directional activity | Sequence | SEQ ID NO: |
|---|---|---|---|
| | | SLILRFVREWSSLTAMKQRIIRKSGQLFCSPILALEEITKQQTKQNCTKRYITKEDVAVA SMDKVKNVGGHVRLITKESRPRDPFTKKLLEDGACVPFLNPYTVQADLTVKPSTSKGYLQ AVDNEGNPLCLRCQQPTCQTKQACKANSWDSRFCSLKCQEEFWIRSNNSYLRAKVFETEH GVCQLCNVNAQELFLRLRDAPKSQRKNLLYATWTSKLPLEQLNEMIRNPGEGHFWQVDHI KPVYGGGGQCSLDNLQTLCTVCHKERTARQAKERSQVRRQSLASKHGSDITRFLVKK | |
| ZRANB3 Isoform 3 CCDS 74580.1 | | MWGMLNRKAQVTGSTLNGRKEKIQAEEGDKEKWDFLQFAEAWTPNDSSEELRKEALFTHF EKEKQHDIRSFFVPQPKKRQLMTSCDESKRFREENTVVSSDPTKTAARDIIDYESDVEPE TKRLKLAASEDHCSPSEETPSQSKQIRTPLVESVQEAKAQLTTPAPFVEGWQCSLCTYIN NSELPYCEMCETPQGSAVMQIDSLNHIQDKNEKDDSQKDTSKKVQTISDCEKQALAQSEP GQLADSKEETPKIEKEDGLTSQPGNEQWKSSDTLPVYDTLMFCASRNTDRIHIYTKDGKQ MSCNFIPLDIKLDLWEDLPASFQLKQYRSLILRFVREWSSLTAMKQRIIRKSGQLFCSPI LALEEITKQQTKQNCTKRYITKEDVAVASMDKVKNVGGHVRLITKESRPRDPFTKKLLED GACVPFLNPYTVQADLTVKPSTSKGYLQAVDNEGNPLCLRCQQPTCQTKQACKANSWDSR FCSLKCQEEFWIRSNNSYLRAKVFETEHGVCQLCNVNAQELFLRLRDAPKSQRKNLLYAT WTSKLPLEQLNEMIRNPGEGHFWQVDHIKPVYGGGGQCSLDNLQTLCTVCHKERTARQAK ERSQVRRQSLASKHGSDITRFLVKK | 45 |
| WRN | | MSEKKLETTAQQRKCPEWMNVQNKRCAVEERKACVRKSVFEDDLPFLEFTGSIVYSYDAS DCSFLSEDISMSLSDGDVVGFDMEWPPLYNRGKLGKVALIQLCVSESKCYLFHVSSMSVF PQGLKMLLENKAVKKAGVGIEGDQWKLLRDFDIKLKNFVELTDVANKKLKCTETWSLNSL VKHLLGKQLLKDKSIRCSNWSKFPLTEDQKLYAATDAYAGFIIYRNLEILDDTVQRFAIN KEEEILLSDMNKQLTSISEEVMDLAKHLPHAFSKLENPRRVSILLKDISENLYSLRRMII GSTNIETELRPSNNLNLLSFEDSTTGGVQQKQIREHEVLIHVEDETWDPTLDHLAKHDGE DVLGNKVERKEDGFEDGVEDNKLKENMERACLMSLDITEHELQILEQQSQEEYLSDIAYK STEHLSPNDNENDTSYVIESDEDLEMEMLKHLSPNDNENDTSYVIESDEDLEMEMLKSLE NLNSGTVEPTHSKCLKMERNLGLPTKEEEEDDENEANEGEEDDDKDFLWPAPNEEQVTCL KMYFGHSSFKPVQWKVIHSVLEERRDNVAVMATGYGKSLCFQYPPVYVGKIGLVISPLIS LMEDQVLQLKMSNIPACFLGSAQSENVLTDIKLGKYRIVYVTPEYCSGNMGLLQQLEADI GITLIAVDEAHCISEWGHDFRDSFRKLGSLKTALPMVPIVALTATASSSIREDIVRCLNL RNPQITCTGFDRPNLYLEVRRKTGNILQDLQPFLVKTSSHWEFEGPTIIYCPSRKMTQQV TGELRKLNLSCGTYHAGMSFSTRKDIHHRFVRDEIQCVIATIAFGMGINKADIRQVIHYG APKDMESYYQEIGRAGRDGLQSSCHVLWAPADINLNRHLLTEIRNEKFRLYKLKMMAKME KYLHSSRCRRQIILSHFEDKQVQKASLGIMGTEKCCDNCRSRLDHCYSMDDSEDTSWDFG PQAFKLLSAVDILGEKFGIGLPILFLRGSNSQRLADQYRRHSLFGTGKDQTESWWKAFSR QLITEGFLVEVSRYNKFMKICALTKKGRNWLHKANTESQSLILQANEELCPKKLLLPSSK TVSSGTKEHCYNQVPVELSTEKKSNLEKLYSYKPCDKISSGSNISKKSIMVQSPEKAYSS SQPVISAQEQEQETQIVLYGKLVEARQKHANKMDVPPAILATNKILVDMAKMRPTTVENVKR IDGVSEGKAAMLAPLLEVIKHFCQTNSVQTDLFSSTKPQEEQKTSLVAKNKICTLSQSMA ITYSLFQEKKMPLKSIAESRILPLMTIGMHLSQAVKAGCPLDLERAGLTPEVQKIIADVI RNPPVNSDMSKISLIRMLVPENIDTYLIHMAIEILKHGPDSGLQPSCDVNKRRCFPGSEE ICSSSKRSKEEVGINTETSSAERKRRLPVWFAKGSDTSKKLMDKTKRGGLFS (WRN CCDS 6082.1) | 46 |
| BLM | | MAAVPQNNLQEQLERHSARTLNNKLSLSKPKFSGFTFKKKTSSDNNVSVTNVSVAKTPVL RNKDVNVTEDFSFSEPLPNTTNQQRVKDFFKNAPAGQETQRGGSKSLLPDFLQTPKEVVC TTQNTPTVKKSRDTALKKLEFSSSPDSLSTINDWDDMDDFDTSETSKSFVTPPQSHFVRV STAQKSKKGKRNFFKAQLYTTNTVKTDLPPPSSESEQIDLTEEQKDDSEWLSSDVICIDD GPIAEVHINEDAQESDSLKTHLEDERDNSEKKKNLEEAELHSTEKVPCIEFDDDDYDTDF VPPSPEEIISASSSSKCLSTLKDLDTSDRKEDVLSTSKDLLSKPEKMSMQELNPETSTD CDARQISLQQQLIHVMEHICKLIDTIPDDKLKLLDCGNELLQQRNIRRKLLTEVDFNKSD ASLLGSLWRYRPDSLDGPMEGDSCPTGNSMKELNFSHLPSNSVSPGDCLLTTTLGKTGFS ATRKNLFERPLFNTHLQKSFVSSNWAETPRLGKKNESSYFPGNVLTSTAVKDQNKHTASI NDLERETQPSYDIDNFDIDDFDDDDWEDIMHNLAASKSSTAAYQPIKEGRPIKSVSERL SSAKTDCLPVSSTAQNINFSESIQNYTDKSAQNLASRNLKHERFQSLSFPHTKEMMKIFH KKFGLHNFRTNQLEAINAALLGEDCFILMPTGGKSLCYQLPACVSPGVTVVISPLRSLI VDQVQKLTSLDIPATYLTGDKTDSEATNIYLQLSKKDPIIKLLYVTPEKICASNRLISTL ENLYERKLLARFVIDEAHCVSQWGHDFRQDYKRMNMLRQKFPSVPVMALTATANPRVQKD ILTQLKILRPQVFSMSFNRHNLKYYVLPKKPKKVAFDCLEWIRKHHPYDSGIIYCLSRRE CDTMADTLQRDGLAALAYHAGLSDSARDEVQQKWINQDGCQVICATIAFGMGIDKPDVRF VIHASLPKSVEGYYQESGRAGRDGEISHCLLFYTYHDVTRLKRLIMMEKDGNHHTRETHF NNLYSMVHYCENITECRRIQLLAYFGENGFNPDFCKKHPDVSCDNCCKTKDYKTRDVTDD VKSIVRFVQEHSSSQGMRNIKHVGPSGRFTMNMLVDIFLGSKSAKIQSGIFGKGSAYSRH NAERLFKKLILDKILDEDLYINANDQAIAYVMLGNKAQTVLNGNLKVDFMETENSSSVKK QKALVAKVSQREEMVKKCLGELTEVCKSLGKVFGVHYFNIFNTVTLKKKLAESLSSDPEVL LQIDGVTEDKLEKYGAEVISVLQKYSEWTSPAEDSSPGISLSSSRGPGRSAAEELDEEIP VSSHYFASKTRNERKRKKMPASQRSKRRKTASSGSKAKGGSATCRKISSKTKSSSIIGSS SASHTSQATSGANSKLGIMAPPKPINRPFLKPSYAFS (BLM Isoform 1 CCDS 10363.1) MAAVPQNNLQEQLERHSARTLNNKLSLSKPKFSGFTFKKKTSSDNNVSVTNVSVAKTPVL RNKDVNVTEDFSFSEPLPNTTNQQRVKDFFKNAPAGQETQRGGSKSLLPDFLQTPKEVVC TTQNTPTVKKSRDTALKKLEFSSSPDSLSTINDWDDMDDFDTSETSKSFVTPPQSHFVRV STAQKSKKGKRNFFKAQLYTTNTVKTDLPPPSSESEQIDLTEEQKDDSEWLSSDVICIDD GPIAEVHINEDAQESDSLKTHLEDERDNSEKKKNLEEAELHSTEKVPCIEFDDDDYDTDF | 47 |

TABLE 2-continued

Helicases

| Name | Directional activity | Sequence | SEQ ID NO: |
|---|---|---|---|
| | | VPPSPEEIISASSSSSKCLSTLKDLDTSDRKEDVLSTSKDLLSKPEKMSMQELNPETSTD<br>CDARQISLQQQLIHVMEHICKLIDTIPDDKLKLLDCGNELLQQRNIRRKLLTEVDFNKSD<br>ASLLGSLWRYRPDSLDGPMEGDSCPTGNSMKELNFSHLPSNSVSPGDCLLTTTLGKTGFS<br>ATRKNLFERPLFNTHLQKSFVSSNWAETPRLGKKNESSYFPGNVLTSTAVKDQNKHTASI<br>NDLERETQPSYDIDNFDIDDFDDDDWEDIMHNLAASKSSTAAYQPIKEGRPIKSVSERL<br>SSAKTDCLPVSSTAQNINFSESIQNYTDKSAQNLASRNLKHERFQSLSFPHTKEMMKIFH<br>KKFGLHNFRTNQLEAINAALLGEDCFILMPTGGGKSLCYQLPACVSPGVTVVISPLRSLI<br>VDQVQKLTSLDIPATYLTGDKTDSEATNIYLQLSKKDPIIKLLYVTPEKICASNRLISTL<br>ENLYERKLLARFVIDEAHCVSQWGHDFRQDYKRMNMLRQKFPSVPVMALTATANPRVQKD<br>ILTQLKILRPQVFSMSFNRHNLKYYVLPKKPKKVAFDCLEWIRKHHPYDSGIIYCLSRRE<br>CDTMADTLQRDGLAALAYHAGLSDSARDEVQQKWINQDGCQVICATIAFGMGIDKPDVRF<br>VIHASLPKSVEGYYQESGRAGRDGEISHCLLFYTYHDVTRLKRLIMMEKDGNHHTRETHF<br>NNLYSMVHYCENITECRRIQLLAYFGENGFNPDFCKKHPDVSCDNCCKTKDYKTRDVTDD<br>VKSIVRFVQEHSSSQGMRNIKHVGPSGRFTMNMLVDIFLESLSSDPEVLLQIDGVTEDKL<br>EKYGAEVISVLQKYSEWTSPAEDSSPGISLSSSRGPGRSAAEELDEEIPVSSHYFASKTR<br>NERKRKKMPASQRSKRRKTASSGSKAKGGSATCRKISSKTKSSSIIGSSSASHTSQATSG<br>ANSKLGIMAPPKPINRPFLKPSYAFS (BLM Isoform 2 CCDS 73782.1) | |
| RECQL4 | | MERLRDVRERLQAWERAFRRQRGRRPSQDDVEAAPEETRALYREYRTLKRTTGQAGGGLRSSE<br>SLPAAAEEAPEPRCWGPHLNRAATKSPQSTPGRSRQGSVPDYGQRLKANLKGTLQAGPALGRR<br>PWPLGRASSKASTPKPPGTGPVPSFAEKVSDEPPQLPEPQPRPGRLQHLQASLSQRLGSLDPG<br>WLQRCHSEVPDFLGAPKACRPDLGSEESQLLIPGESAVLGPGAGSQGPEASAFQEVSIRVGSP<br>QPSSSGGEKRRWNEEPWESPAQVQQESSQAGPPSEGAGAVAVEEDPPGEPVQAQPPQPCSSPS<br>NPRYHGLSPSSQARAGKAEGTAPLHIFPPRLARHDRGNYVRLNMKQKHYVRGRALRSRLLRKQA<br>WKQKWRKKGECFGGGGATVTTKESCFLNEQFDHWAAQCPRPASEEDTDAVGPEPLVPSPQPVP<br>EVPSLDPTVLPLYSLGPSGQLAETPAEVFQALEQLGHQAFRPGQERAVMRILSGISTLLVLPT<br>GAGKSLCYQLPALLYSRRSPCLTLVVSPLLSLMDDQVSGLPPCLKAACIHSGMTRKQRESVLQ<br>KIRAAQVHVLMLTPEALVGAGGLPPAAQLPPVAFACIDEAHCLSQWSHNFRPCYLRVCKVLRE<br>RMGVHCFLGLTATATRRTASDVAQHLAVAEEPDLHGPAPVPTNLHLSVSMDRDTDQALLTLLQ<br>GKRFQNLDSIIIYCNRREDTERIAALLRTCLHAAWVPGSGGRAPKTTAEAYHAGMCSRERRRV<br>QRAPMQGQLRVVATVAFGMGLDRPDVRAVLHLGLPPSFESYVQAVGRAGRDGQPAHCHLFLQ<br>PQGEDLRELRRHVADSTDFLAVKRLVQRVFPACTCTCTRPPSEQEGAVGGERPVPKYPPQEA<br>EQLSHQAAPGPRRVCMGHERALPIQLTVQALDMPEEAIETLLCYLELHPHHWLELLATTYTHC<br>RLNCPGGPAQLQALAHRCPPLAVCLAQQLPEDPGQGSSSVEFDMVKLVDSMGWELASVRRALC<br>QLQWDHEPRTGVRRGTGVLVEFSELAFHLRSPGDLTAEEKDQICDFLYGRVQARERQALARLR<br>RTFQAFHSVAFPSCGPCLEQQDEERSTRLKDLLGRYFEEEEGQEPGGMEDAQGPEPGQARLQD<br>WEDQVRCDIRQFLSLRPEEKFSSRAVARIFHGIGSPCYPAQVYGQDRRFWRKYLHLSFHALVG<br>LATEELLQVAR (RECQ4, CCDS 75804.1) | 48 |
| RECQL1 | | MASVSALTEELDSITSELHAVEIQIQELTERQQELIQKKKVLTKKIKQCLEDSDAGASNE<br>YDSSPAAWNKEDFPWSGKVKDILQNVFKLEKFRPLQLETINVTMAGKEVFLVMPTGGGKS<br>LCYQLPALCSDGFTLVICPLISLMEDQLMVLKQLGISATMLNASSSKEHVKWVHAEMVNK<br>NSELKLIYVTPEKIAKSKMFMSRLEKAYEARRFTRIAVDEVHCCSQWGHDFRPDYKALGI<br>LKRQFPNASLIGLTATATNHVLTDAQKILCIEKCFTFTASFNRPNLYYEVRQKPSNTEDF<br>IEDIVKLINGRYKGQSGIIYCFSQKDSEQVTVSLQNLGIHAGAYHANLEPEDKTTVHRKW<br>SANEIQVVVATVAFGMGIDKPDVRFVIHHSMSKSMENYYQESGRAGRDDMKADCILYYGF<br>GDIFRISSMVVMENVGQQKLYEMVSYCQNISKCRRVLMAQHFDEVWNSEACNKMCDNCCK<br>DSAFERKNITEYCRDLIKILKQAEELNEKLTPLKLIDSWMGKGAAKLRVAGVVAPTLPRE<br>DLEKIIAHFLIQQYLKEDYSFTAYATISYLKIGPKANLLNNEAHAITMQVTKSTQNSFRA<br>ESSSQTCHSEQGDKKMEEKNSGNFQKKAANMLQQSGSKNTGAKKRKIDDA (RECQL1<br>CCDS 31756.1) | 49 |
| XPB | | MGKRDRADRDKKKSRKRHYEDEEDDEEDAPGNDPQEAVPSAAGKQVDESGTKVDEYGAKD<br>YRLQMPLKDDHTSRPLWVAPDGHIFLEAFSPVYKYAQDFLVAIAEPVCRPTHVHEYKLTA<br>YSLYAAVSVGLQTSDITEYLRKLSKTGVPDGIMQFIKLCTVSYGKVKVLVLKHNRYFVESC<br>HPDVIQHLLQDPVIRECRLRNSEGEATELITETFTSKSAISKTAESSGGPSTSRVTDPQG<br>KSDIPMDLFDFYEQMDKDEEEEETQTVSFEVKQEMIEELQKRCIHLEYPLLAEYDFRND<br>SVNPDINIDLKPTAVLRPYQEKSLRKMFGNGRARSGVIVLPCGAGKSLVGVTAACTVRKR<br>CLVLGNSAVSVEQWKAQFKMWSTIDDSQICRFTSDAKDKPIGCSVAISTYSMLGHTTKRS<br>WEAERVMEWLKTQEWGLMILDEVHTIPAKMFRRVLTIVQAHCKLGLTATLVREDDKIVDL<br>NFLIGPKLYEANWMELQNNGYIAKVQCAEVWCPMSPEFYREYVAIKTKKRILLYTMNPNK<br>FRACQFLIKFHERRNDKIIVFADNVFALKEYAIRLNKPYIYGPTSQGERMQILQNFKHNP<br>KINTIFISKVGDTSFDLPEANVLIQISSHGGSRRQEAQRLGRVLRAKKGMVAEEYNAFFY<br>SLVSQDTQEMAYSTKRQRFLVDQGYSFKVITKLAGMEEEDLAFSTKEEQQQLLQKVLAAT<br>DLDAEEEVVAGEFGSRSSQASRRFGTMSSMSGADDTVYMEYHSSRSKAPSKHVHPLFKRF<br>RK (XPB CCDS 2144.1) | 50 |
| XPD | | MKLNVDGLLVYFPYDYIYPEQFSYMRELKRTLDAKGHGVLEMPSGTGKTVSLLALIMAYQ<br>RAYPLEVTKLIYCSRTVPEIEKVIEELRKLLNFYEKQEGEKLPFLGLALSSRKNLCIHPE<br>VTPLRFGKDVDGKCHSLTASYVRAQYQHDTSLPHCRFYEEFDAHGREVPLPAGIYNLDDL<br>KALGRRQGWCPYFLARYSILHANVVVYSYHYLLDPKIADLVSKELARKAVVVFDEAHNID<br>NVCIDSMSVNLTRRTLDRCQGNLETLQKTVLRIKETDEQRLRDEYRRLVEGLREASAARE<br>TDAHLANPVLPDEVLQEAVPGSIRTAEHFLGFLRRLLEYVKWRLRVQHVVQESPPAFLSG<br>LAQRVCIQRKPLRFCAERLRSLLHTLEITDLADFSPLTLLANFATLVSTYAKGFTIIIEP | 51 |

TABLE 2-continued

Helicases

| Name | Directional activity | Sequence | SEQ ID NO: |
|---|---|---|---|
| | | FDDRTPTIANPILHFSCMDASLAIKPVFERFQSVIITSGTLSPLDIYPKILDFHPVTMAT FTMTLARVCLCPMIIGRGNDQVAISSKFETREDIAVIRNYGNLLLEMSAVVPDGIVAFFT SYQYMESTVASWYEQGILENIQRNKLLFIETQDGAETSVALEKYQEACENGRGAILLSVA RGKVSEGIDFVHHYGRAVIMFGVPYVYTQSRILKARLEYLRDQFQIRENDFLTFDAMRHA AQCVGRAIRGKTDYGLMVFADKRFARGDKRGKLPRWIQEHLTDANLNLTVDEGVQVAKYF LRQMAQPFHREDQLGLSLLSLEQLESEETLKRIEQIAQQL (XPD Isoform 1 CCDS 33049.1) MRELKRTLDAKGHGVLEMPSGTGKTVSLLALIMAYQRAYPLEVTKLIYCSRTVPEIEKVI EELRKLLNFYEKQEGEKLPFLGLALSSRKNLCIHPEVTPLRFGKDVDGKCHSLTASYVRA QYQHDTSLPHCRFYEEFDAHGREVPLPAGIYNLDDLKALGRRQGWCPYFLARYSILHANV VVYSYHYLLDPKIADLVSKELARKAVVVPDEAHNIDNVCIDSMSVNLTRRTLDRCQGNLE TLQKTVLRIKETDEQRLRDEYRRLVEGLREASAARETDAHLANPVLPDEVLQEAVPGSIR TAEHFLGFLRRLLEYVKWRLRVQHVVQESPPAFLSGLAQRVCIQRKPLRFCAERLRSLLH TLEITDLADFSPLTLLANFATLVSTYAKGQAQHCGSSRNQKRSHP (XPD Isoform 2 CCDS 46112.1) | |
| FANCJ/ BACH1 | | MSLSENSVFAYESSVHSTNVLLSLNDQRKKDVLCDVTIFVEGQRFRAHRSVLAACSSYFHSRI VGQADGELNITLPEEVTVKGFEPLIQFAYTAKLILSKENVDEVCKCVEFLSVHNIEESCFQFL KFKFPLDSTADQQECPRKKCFSSHCQKTDLKLSLLDQRDLETDEVEEFLENKNVQTPQCKLRRY QGNAKASPPLQDSASQTYESMCLEKDAALALPSLCPKYRKFQKAFGTDRVRTGESSVKDIHAS VQPNERSENECLGGVPECRDLQVMLKCDESKLAMEPEETKKDPASQCPTEKSEVTPFFPHNSSI DPHGLYSLSLLHTYDQYGDLNFAGMQNTTVLTEKPLSGTDVQEKTFGESQDLPLKSDLGTRED SSVASSDRSSVEREVAEHLAKGFWSDICSTDTPCQMQLSPAVAKDGSEQISQKRSECPWLGIR ISESPEPGQRTFTTLSSVNCPFISTLSTEGCSSNLEIGNDDYVSEPQQEPCPYACVISLGDDS ETDTEGDSESCSAREQECEVKLPFNAQRIISLSRNDFQSLLKMHKLTPEQLDCIHDIRRRSKN RIAAQRCRKRKLDCIQNLESEIEKLQSEKESLLKERDHILSTLGETKQNLTGLCQKVCKEAAL SQEQIQILAKYSAADCPLSFLISEKDKSTPDGELALPSIFSLSDRPPAVLPPCARGNSEPGYA RGQESQQMSTATSEQAGPAEQCRQSGGISDFCQQMTDKCTTDE (transcription regulator protein BACH1 [Homo sapiens] CCDS 13585.1) | 52 |
| RTEL | | MPKIVLNGVTVDFPFQPYKCQQEYMTKVLECLQQKVNGILESPTGTGKTLCLLCTTLAWR EHLRDGISARKIAERAQGELFPDRALSSWGNAAAAAGDPIACYTDIPKIIYASRTHSQLT QVINELRNTSYRPKVCVLGSREQLCIHPEVKKQESNHLQIHLCRKKVASRSCHFYNNVEE KSLEQELASPILDIEDLVKSGSKHRVCPYYLSRNLKQQADIIFMPYNYLLDAKSRRAHNI DLKGTVVIFDEAHNVEKMCEESASFDLTPHDLASGLDVIDQVLEEQTKAAQQGEPHPEFS ADSPSPGLNMELEDIAKLKMILLRLEGAIDAVELPGDDSGVTKPGSYIFELFAEAQITFQ TKGCILDSLDQIIQHLAGRAGVFTNTAGLQKLADIIQIVFSVDPSEGSPGSPAGLGALQS YKVHIHPDAGHRRTAQRSDAWSTTAARKRGKVLSYWCFSPGHSMHELVRQGVRSLILTSG TLAPVSSFALEMQIPFPVCLENPHIIDKHQIWVGVVPRGPDGAQLSSAFDRRFSEECLSS LGKALGNIARVVPYGLLIFFPSYPVMEKSLEFWRARDLARKMEALKPLFVEPRSKGSFSE TISAYYARVAAPGSTGATFLAVCRGKASEGLDFSDTNGRGVIVTGLPYPPRMDPRVVLKM QFLDEMKGQGGAGGQFLSGQEWYRQQASRAVNQAIGRVIRHRQDYGAVFLCDHRFAFADA RAQLPSWVRPHVRVYDNFGHVIRDVAQFFRVAERTMPAPAPRATAPSVRGEDAVSEAKSP GPFFSTRKAKSLDLHVPSLKQRSSGSPAAGDPESSLCVEYEQEPVPARQRPRGLLAALEH SEQRAGSPGEEQAHSCSTLSLLSEKRPAEEPRGGRKKIRLVSHPEEPVAGAQTDRAKLFM VAVKQELSQANFATFTQALQDYKGSDDFAALAACLGPLFAEDPKKHNLLQGFYQFVRPHH KQQFEEVCIQLTGRGCGYRPEHSIPRRQRAQPVLDPTGRTAPDPKLTVSTAAAQQLDPQE HLNQGRPHLSPRPPPTGDPGSQPQWGSGVPRAGKQGQHAVSAYLADARRALGSAGCSQLL AALTAYKQDDDLDKVLAVLAALTTAKPEDFPLLHRFSMFVRPHHKQRFSQTCTDLTGRPY PGMEPPGPQEERLAVPPVLTHRAPQPGPSRSEKTGKTQSKISSFLRQRPAGTVGAGGEDA GPSQSSGPPHGPAASEWGL (RTEL Isoform 1 CCDS 13531.1) MPKIVLNGVTVDFPFQPYKCQQEYMTKVLECLQQKVNGILESPTGTGKTLCLLCTTLAWR EHLRDGISARKIAERAQGELFPDRALSSWGNAAAAAGDPIACYTDIPKIIYASRTHSQLT QVINELRNTSYRSRCRATLWVLETAPPRPTVLSPTRPKVCVLGSREQLCIHPEVKKQESN HLQIHLCRKKVASRSCHFYNNVEEKSLEQELASPILDIEDLVKSGSKHRVCPYYLSRNLK QQADIIFMPYNYLLDAKSRRAHNIDLKGTVVIFDEAHNVEKMCEESASFDLTPHDLASGL DVIDQVLEEQTKAAQQGEPHPEFSADSPSPGLNMELEDIAKLKMILLRLEGAIDAVELPG DDSGVTKPGSYIFELFAEAQITFQTKGCILDSLDQIIQHLAGRAGVFTNTAGLQKLADII QIVFSVDPSEGSPGSPAGLGALQSYKVHIHPDAGHRRTAQRSDAWSTTAARKRGKVLSYW CFSPGHSMHELVRQGVRSLILTSGTLAPVSSFALEMQIPFPVCLENPHIIDKHQIWVGVV PRGPDGAQLSSAFDRRFSEECLSSLGKALGNIARVVPYGLLIFFPSYPVMEKSLEFWRAR DLARKMEALKPLFVEPRSKGSFSETISAYYARVAAPGSTGATFLAVCRGKASEGLDFSDT NGRGVIVTGLPYPPRMDPRVVLKMQFLDEMKGQGGAGGQFLSGQEWYRQQASRAVNQAIG RVIRHRQDYGAVFLCDHRFAFADARAQLPSWVRPHVRVYDNFGHVIRDVAQFFRVAERTM PAPAPRATAPSVRGEDAVSEAKSPGPFFSTRKAKSLDLHVPSLKQRSSGSPAAGDPESSL CVEYEQEPVPARQRPRGLLAALEHSEQRAGSPGEEQAHSCSTLSLLSEKRPAEEPRGGRK KIRLVSHPEEPVAGAQTDRAKLFMVAVKQELSQANFATFTQALQDYKGSDDFAALAACLG PLFAEDPKKHNLLQGFYQFVRPHHKQQFEEVCIQLTGRGCGYRPEHSIPRRQRAQPVLDP TGRTAPDPKLTVSTAAAQQLDPQEHLNQGRPHLSPRPPPTGDPGSQPQWGSGVPRAGKQG QHAVSAYLADARRALGSAGCSQLLAALTAYKQDDDLDKVLAVLAALTTAKPEDFPLLHRF SMFVRPHHKQRFSQTCTDLTGRPYPGMEPPGPQEERLAVPPVLTHRAPQPGPSRSEKTGK TQSKISSFLRQRPAGTVGAGGEDAGPSQSSGPPHGPAASEWGL (RTEL Isoform 2 CCDS 13530.3) | 53 |

TABLE 2-continued

Helicases

| Name | Directional activity | Sequence | SEQ ID NO: |
|---|---|---|---|
| | | MPKIVLNGVTVDFPFQPYKCQQEYMTKVLECLQQKVNGILESPTGTGKTLCLLCTTLAWR
EHLRDGISARKIAERAQGELFPDRALSSWGNAAAAAGDPIACYTDIPKIIYASRTHSQLT
QVINELRNTSYRPKVCVLGSREQLCIHPEVKKQESNHLQIHLCRKKVASRSCHFYNNVEE
KSLEQELASPILDIEDLVKSGSKHRVCPYYLSRNLKQQADIIFMPYNYLLDAKSRRAHNI
DLKGTVVIFDEAHNVEKMCEESASFDLTPHDLASGLDVIDQVLEEQTKAAQQGEPHPEFS
ADSPSPGLNMELEDIAKLKMILLRLEGAIDAVELPGDDSGVTKPGSYIFELFAEAQITFQ
TKGCILDSLDQIIQHLAGRAGVFTNTAGLQKLADIIQIVFSVDPSEGSPGSPAGLGALQS
YKVHIHPDAGHRRTAQRSDAWSTTAARKRGKVLSYWCFSPGHSMHELVRQGVRSLILTSG
TLAPVSSFALEMQIPFPVCLENPHIIDKHQIWVGVVPRGPDGAQLSSAFDRRFSEECLSS
LGKALGNIARVVPYGLLIFFPSYPVMEKSLEFWRARDLARKMEALKPLFVEPRSKGSFSE
TISAYYARVAAPGSTGATFLAVCRGKASEGLDFSDTNGRGVIVTGLPYPPRMDPRVVLKM
QFLDEMKGQGGAGGQFLSGQEWYRQQASRAVNQAIGRVIRHRQDYGAVFLCDHRFAFADA
RAQLPSWVRPHVRVYDNFGHVIRDVAQFFRVAERTMPAPAPRATAPSVRGEDAVSEAKSP
GPFFSTRKAKSLDLHVPSLKQRSSGSPAAGDPESSLCVEYEQEPVPARQRPRGLLAALEH
SEQRAGSPGEEQAHSCSTLSLLSEKRPAEEPRGGRKKIRLVSHPEEPVAGAQTDRAKLFM
VAVKQELSQANFATFTQALQDYKGSDDFAALAACLGPLFAEDPKKHNLLQGFYQFVRPHH
KQQFEEVCIQLTGRGCGYRPEHSIPRRQRAQPVLDPTGRTAPDPKLTVSTAAAQQLDPQE
HLNQGRPHLSPRPPPTGDPGSQPQWGSGVPRAGKQGQHAVSAYLADARRALGSAGCSQLL
AALTAYKQDDDLDKVLAVLAALTTAKPEDFPLLHRFSMFVRPHHKQRFSQTCTDLTGRPY
PGMEPPGPQEERLAVPPVLTHRAPQPGPSRSEKTGKTQSKISSFLRQRPAGTVGAGGEDA
GPSQSSGPPHGPAASEWGEPHGRDIAGQQATGAPGGPLSAGCVCQGCGAEDVVPFQCPAC
DFQRCQACWQRHLQASRMCPACHTASRKQSVMQVFWPEPQ (RTEL Isoform 3 CCDS 63331.1) | |
| | | MPYNYLLDAKSRRAHNIDLKGTVVIFDEAHNVEKMCEESASFDLTPHDLASGLDVIDQVL
EEQTKAAQQGEPHPEFSADSPSPGLNMELEDIAKLKMILLRLEGAIDAVELPGDDSGVTK
PGSYIFELFAEAQITFQTKGCILDSLDQIIQHLAGRAGVFTNTAGLQKLADIIQIVFSVD
PSEGSPGSPAGLGALQSYKVHIHPDAGHRRTAQRSDAWSTTAARKRGKVLSYWCFSPGHS
MHELVRQGVRSLILTSGTLAPVSSFALEMQIPFPVCLENPHIIDKHQIWVGVVPRGPDGA
QLSSAFDRRFSEECLSSLGKALGNIARVVPYGLLIFFPSYPVMEKSLEFWRARDLARKME
ALKPLFVEPRSKGSFSETISAYYARVAAPGSTGATFLAVCRGKASEGLDFSDTNGRGVIV
TGLPYPPRMDPRVVLKMQFLDEMKGQGGAGGQFLSGQEWYRQQASRAVNQAIGRVIRHRQ
DYGAVFLCDHRFAFADARAQLPSWVRPHVRVYDNFGHVIRDVAQFFRVAERTMPAPAPRA
TAPSVRGEDAVSEAKSPGPFFSTRKAKSLDLHVPSLKQRSSGSPAAGDPESSLCVEYEQE
PVPARQRPRGLLAALEHSEQRAGSPGEEQAHSCSTLSLLSEKRPAEEPRGGRKKIRLVSH
PEEPVAGAQTDRAKLFMVAVKQELSQANFATFTQALQDYKGSDDFAALAACLGPLFAEDP
KKHNLLQGFYQFVRPHHKQQFEEVCIQLTGRGCGYRPEHSIPRRQRAQPVLDPTGRTAPD
PKLTVSTAAAQQLDPQEHLNQGRPHLSPRPPPTGDPGSQPQWGSGVPRAGKQGQHAVSAY
LADARRALGSAGCSQLLAALTAYKQDDDLDKVLAVLAALTTAKPEDFPLLHRFSMFVRPH
HKQRFSQTCTDLTGRPYPGMEPPGPQEERLAVPPVLTHRAPQPGPSRSEKTGKTQSKISS
FLRQRPAGTVGAGGEDAGPSQSSGPPHGPAASEWGL (RTEL Isoform 4 CCDS 74751.1) | |

Petite integration frequency 1 (Pif1) has 5' to 3' ATP-dependent helicase activity and possesses intrinsic strand annealing activity. Pif1 participates in telomere maintenance by inhibiting telomerase activity and negatively regulating telomere length, and genomic and mitochondrial replication. Use of a Pif1 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of repair seen with an RNA-guided nuclease, e.g., Cas9 molecule, in the absence of increased expression of an endogenous Pif1 RMEM and/or overexpression of a heterologous Pif1 RMEM. Candidate Pif1 RMEMs can be evaluated for c-NHEJ, alt-NHEJ (including blunt EJ, MMEJ, and SD-MMEJ), and HDR (including alt-HR, HR, and SSA) by using any of the functional assays described herein.

SWI/SNF related, matrix associated, actin dependent regulator of chromatin, subfamily A-like 1 (HARP/SMARCAL1; hereinafter "HARP") is a member of the SWI/SNF family with helicase and ATPase activity that catalyzes the rewinding of stably unwound DNA. HARP/SMARCAL1 alters the chromatin structure around target genes to modulate gene expression. HARP/SMARCAL1 plays a role in restarting the replication fork (see, e.g., Ciccia et al. (2012) MOL. CELL. 47(3): 396-409). Use of a HARP RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of repair seen with an RNA-guided nuclease, e.g., Cas9 molecule, in the absence of increased expression of an endogenous HARP RMEM and/or overexpression of a heterologous HARP RMEM. Candidate HARP RMEMs can be evaluated for c-NHEJ, alt-NHEJ (including blunt EJ, MMEJ, and SD-MMEJ), and HDR (including alt-HR, HR, and SSA) by using any of the functional assays described herein.

Zinc finger, RAN-binding domain containing 3 (ZRANB3) has DNA annealing and endonuclease activity. ZRANB3 is recruited to damaged, stalled, or collapsed replication forks, and facilitates fork restart or participates in the repair of replication-blocking lesions. (Ciccia et al. (2012)). Use of a ZRANB3 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of repair seen with an RNA-guided nuclease, e.g., Cas9 molecule, in the absence of increased expression of an endogenous ZRANB3 RMEM and/or overexpression of a heterologous ZRNAB3 RMEM. Candidate ZRANB3 RMEMs can be evaluated for c-NHEJ, alt-NHEJ (including blunt EJ, MMEJ, and SD-MMEJ), and HDR (including alt-HR, HR, and SSA) by using any of the functional assays described herein.

In one embodiment, the RMEM is Pif1, HARP/SMARCAL1, or ZRANB3. In another embodiment, the RMEM having helicase activity is not WRN, BLM, RECQL4, RECQL1, XPB, XPD, FancJ/BACH1, or RTEL. In another embodiment, the RMEM does not have DNA helicase activity.

Terminal Deoxynucleotidyl Transferase (TdT)

In one embodiment, the RMEM has terminal deoxynucleotidyl transferase activity. In one embodiment, the RMEM having terminal deoxynucleotidyl transferase activity is TdT. TdT catalyzes the addition of nucleotides to the 3' terminus of a DNA molecule and does not require a template. TdT prefers a 3' overhang but can also add nucleotides to blunt or recessed 3' ends. Exemplary TdTs are provided in Table 3 below and are further described below.

11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is TdT, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing gene conversion of the nucleic acid at the target position in the cell, or in the population of cells. In one embodiment, gene conversion in a cell, or a population of cells is suppressed (or decreased) by about 1-fold, by about 1.5-fold, by about

TABLE 3

Terminal Deoxynucleotidyl Transferases

| Name | Sequence | SEQ ID NO: |
|---|---|---|
| TdT | MDPPRASHLSPRKKRPRQTGALMASSPQDIKFQDLVVFILEKKMGTTRRAFLMELARRKGFRV ENELSDSVTHIVAENNSGSDVLEWLQAQKVQVSSQPELLDVSWLIECIRAGKPVEMTGKHQLV VRRDYSDSTNPGPPKTPPIAVQKISQYACQRRTTLNNCNQIFTDAFDILAENCEFRENEDSCV TFMRAASVLKSLPFTIISMKDTEGIPCLGSKVKGIIEEIIEDGESSEVKAVLNDERYQSFKLF TSVFGVGLKTSEKWFRMGFRTLSKVRSDKSLKFTRMQKAGFLYYEDLVSCVTRAEAEAVSVLV KEAVWAFLPDAFVTMTGGFRRGKKMGHDVDFLITSPGSTEDEEQLLQKVMNLWEKKGLLLYYD LVESTFEKLRLPSRKVDALDHFQKCFLIFKLPRQRVDSDQSSWQEGKTWKAIRVDLVLCPYER RAFALLGWTGSRQFERDLRRYATHERKMILDNHALYDKTKRIFLKAESEEEIFAHLGLDYIEP WERNA | 54 |

In another embodiment, the RMEM does not have terminal deoxynucleotidyl transferase activity.

In another embodiment, the present disclosure provides a method of suppressing the formation of a deletion in a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is TdT, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing the formation of a deletion in the nucleic acid at the target position in the cell, or in the population of cells. In one embodiment, the formation of a deletion in a nucleic acid at a target position in a cell, or a population of cells is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene correction of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is TdT, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing gene correction of the nucleic acid at the target position in the cell, or in the population of cells. In one embodiment, gene correction in a cell, or a population of cells is suppressed (or decreased) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of enhancing the formation of an insertion in a nucleic acid at a target position in a cell, or a population of cells, by contacting the cell, or the population of cells, with (a) a gRNA molecule, (b) a RNA-guided nuclease molecule; and (c) a heterologous Repair-Modulating Enzyme Molecule (RMEM), wherein the RMEM is TdT, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby enhancing formation of an insertion in the nucleic acid at the target position in the cell, or in the population of cells. In one embodiment, the formation of an insertion in a nucleic acid at a target position in a cell, or a population of cells is enhanced (or increased) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

Repair Proteins

In some embodiments, the RMEM is a repair protein. In one embodiment, the repair protein is 53Bp1 Dominant negative, Timeless, or Tipin. Exemplary repair proteins are provided in Table 6 and are further described below.

TABLE 4

Repair Proteins

| Name | Sequence | SEQ ID NO: |
|---|---|---|
| 53Bp1 Dominant negative | 53BP1 dominant negative Mutant 1: 53bp1_(1221-1718) - with ATG start and TAA stop<br>AA-seq<br>MGEEEFDMPQPPHGHVLHRHMRTIREVRTLVTRVITDVYYVDGTEVERKVTEETEEPIVECQE<br>CETEVSPSQTGGSSGDLGDISSFSSKASSLHRTSSGTSLSAMHSSGSSGKGAGPLRGKTSGTE<br>PADFALPSSRGGPGKLSPRKGVSQTGTPVCEEDGDAGLGIRQGGKAPVTPRGRGRRGRPPSRT<br>TGTRETAVPGPLGIEDISPNLSPDDKSFSRVVPRVPDSTRRTDVGAGALRRSDSPEIPFQAAA<br>GPSDGLDASSPGNSFVGLRVVAKWSSNGYFYSGKITRDVGAGKYKLLFDDGYECDVLGKDILL<br>CDPIPLDTEVTALSEDEYFSAGVVKGHRKESGELYYSIEKEGQRKWYKRMAVILSLEQGNRLR<br>EQYGLGPYEAVTPLTKAADISLDNLVEGKRKRRSNVSSPATPTASSSSSTTPTRKITESPRAS<br>MGVLSGKRKLITSEEERSPAKRGRKSATVKPGAVGAGEFVSPCESGDNTGEPSALEEQ*<br>53BP1 dominant negative Mutant 2: 53bp1_(1052-1710) - with ATG start and TAA stop<br>AA-seq<br>MDPPTTPIRGNLLHFPSSQGEEEKEKLEGDHTIRQSQQPMKPISPVKDPVSPASQKMVIQGPS<br>SPQGEAMVTDVLEDQKEGRSTNKENPSKALIERPSQNNIGIQTMECSLRVPETVSAATQTIKN<br>VCEQGTSTVDQNFGKQDATVQTERGSGEKPVSAPGDDTESLHSQGEEEFDMPQPPHGHVLHRH<br>MRTIREVRTLVTRVITDVYYVDGTEVERKVTEETEEPIVECQECETEVSPSQTGGSSGDLGDI<br>SSFSSKASSLHRTSSGTSLSAMHSSGSSGKGAGPLRGKTSGTEPADFALPSSRGGPGKLSPRK<br>GVSQTGTPVCEEDGDAGLGIRQGGKAPVTPRGRGRRGRPPSRTTGTRETAVPGPLGIEDISPN<br>LSPDDKSFSRVVPRVPDSTRRTDVGAGALRRSDSPEIPFQAAAGPSDGLDASSPGNSFVGLRV<br>VAKWSSNGYFYSGKITRDVGAGKYKLLFDDGYECDVLGKDILLCDPIPLDTEVTALSEDEYFS<br>AGVVKGHRKESGELYYSIEKEGQRKWYKRMAVILSLEQGNRLREQYGLGPYEAVTPLTKAADI<br>SLDNLVEGKRKRRSNVSSPATPTASSSSSTTPTRKITESPRASMGVLSGKRKLITSEEERSPA<br>KRGRKSATVKPGAVGAGEFVSPCESGDNTG* | 55 |
| Timeless | MDLHMMNCELLATCSALGYLEGDTYHKEPDCLESVKDLIRYLRHEDETRDVRQQLGAAQILQS<br>DLLPILTQHHQDKPLFDAVIRLMVNLTQPALLCFGNLPKEPSFRHHFLQVLTYLQAYKEAFAS<br>EKAFGVLSETLYELLQLGWEERQEEDNLLIERILLLVRNILHVPADLDQEKKIDDDASAHDQL<br>LWAIHLSGLDDLLLFLASSSAEEQWSLHVLEIVSLMFRDQNPEQLAGVGQGRLAQERSADFAE<br>LEVLRQREMAEKKTRALQRGNRHSRFGGSYIVQGLKSIGERDLIFHKGLHNLRNYSSDLGKQP<br>KKVPKRRQAARELSIQRRSALNVRLFLRDFCSEFLENCYNRLMGSVKDHLLREKAQQHDETYY<br>MWALAFFMAFNRAASFRPGLVSETLSVRTFHFIEQNLTNYYEMMLTDRKEAASWARRMHLALK<br>AYQELLATVNEMDISPDEAVRESSRIIKNNIFYVMEYRELFLALFRKFDERCQPRSFLRDLVE<br>TTHLFLKMLERFCRSRGNLVVQNKQKKRRKKKKVLDQAIVSGNVPSSPEEVEAVWPALAEQL<br>QCCAQNSELSMDSVVPFDAASEVPVEEQRAEAMVRIQDCLLAGQAPQALTLLRSAREVWPEGD<br>VFGSQDISPEEEIQLLKQILSAPLPRQQGPEERGAEEEEEEEEEEELQVVQVSEKEFNFLD<br>YLKRFACSTVVRAYVLLLRSYQQNSAHTNHCIVKMLHRLAHDLKMEALLFQLSVFCLFNRLLS<br>DPAAGAYKELVTFAKYILGKFFALAAVNQKAFVELLFWKNTAVVREMTEGYGSLDDRSSSRRA<br>PTWSPEEEAHLRELYLANKDVEGQDVVEAILAHLNTVPRTRKQIIHHLVQMGLADSVKDFQRK<br>GTHIVLWTGDQELELQRLFEEFRDSDDVLGHIMKNITAKRSRARIVDKLLALGLVAERRELYK<br>KRQKKLASSILPNGAESLKDFCQEDLEEEENLPEEDSEEEEGGSEAEQVQGSLVLSNENLGQ<br>SLHQEGFSIPLLWLQNCLIRAADDREEDGCSQAVPLVPLTEENEEAMENEQFQQLLRKLGVRP<br>PASGQETFWRIPAKLSPTQLRRAAASLSQPEEEQKLQPELQPKVPGEQGSDEEHCKEHRAQAL | 56 |

TABLE 4-continued

Repair Proteins

| Name | Sequence | SEQ ID NO: |
|------|----------|------------|
|  | RALLLAHKKKAGLASPEEEDAVGKEPLKAAPKKRQLLDSDEEQEEDEGRNRAPELGAPGIQKK KRYQIEDDEDD\|NP_003911.2\|protein timeless homolog [Homo sapiens] |  |
| Tipin | MLEPQENGVIDLPDYEHVEDETFPPFPPPASPERQDGEGTEPDEESGNGAPVPVPPKRTVKRN IPKLDAQRLISERGLPALRHVFDKAKFKGKGHEAEDLKMLIRHMEHWAHRLFPKLQFEDFIDR VEYLGSKKEVQTCLKRIRLDLPILHEDFVSNNDEVAENNEHDVTSTELDPFLTNLSESEMFAS ELSRSLTEEQQQRIERNKQLALERRQAKLLSNSQTLGNDMLMNTPRAHTVEEVNTDEDQKEES NGLNEDILDNPCNDAIANTLNEEETLLDQSFKNVQQQLDATSRNITEAR\|NP_060328.2\| TIMELESS-interacting protein isoform 1 [Homo sapiens] MLIRHMEHWAHRLFPKLQFEDFIDRVEYLGSKKEVQTCLKRIRLDLPILHEDFVSNNDEVAEN NEHDVTSTELDPFLTNLSESEMFASELSRSLTEEQQQRIERNKQLALERRQAKLLSNSQTLGN DMLMNTPRAHTVEEVNTDEDQKEESNGLNEDILDNPCNDAIANTLNEEETLLDQSFKNVQQQL DATSRNITEAR\|NP_001276915.1\|TIMELESS-interacting protein isoform 2 [Homo sapiens] | 57 |

In one embodiment, the RMEM is not 53BP1 dominant negative.

In another embodiment, the present disclosure provides a method of enhancing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is 53BP1 dominant negative; wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby enhancing gene conversion of the nucleic acid at the target position in the cell, or in the population of cells. In one embodiment, the frequency of gene conversion is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing the formation of an insertion in a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is 53BP1 dominant negative, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing formation of an insertion in the nucleic acid at the target position in the cell, or in the population of cells.

In one embodiment, the formation of an insertion in the nucleic acid is decreased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of enhancing gene correction of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Rad52 or 53BP1 dominant negative, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby enhancing gene correction of the nucleic acid at the target position in the cell, or in the population of cells. In one embodiment, the frequency of gene correction is increased by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

Telomeric Proteins

In one embodiment, the RMEM is a telomeric protein. In one embodiment, the telomeric protein is TRF1 or TRF2. Exemplary telomeric proteins are provided in Table 4 and are further described below.

TABLE 5

Telomeric Proteins

| Name | Sequence | SEQ ID NO: |
|---|---|---|
| TRF1 | MAEDVSSAAPSPRGCADGRDADPTEEQMAETERNDEEQFECQELLECQVQVGAPEEEEEEEED AGLVAEAEAVAAGWMLDFLCLSLCRAFRDGRSEDFRRTRNSAEAIIHGLSSLTACQLRTIYIC QFLTRIAAGKTLDAQFENDERITPLESALMIWGSIEKEHDKLHEEIQNLIKIQAIAVCMENGN FKEAEEVFERIFGDPNSHMPFKSKLLMIISQKDTFHSFFQHFSYNHMMEKIKSYVNYVLSEKS STFLMKAAAKVVESKRTRTITSQDKPSGNDVEMETEANLDTRKRSHKNLFLSKLQHGTQQQDL NKKERRVGTPQSTKKKKESRRATESRIPVSKSQPVTPEKHRARKRQAWLWEEDKNLRSGVRKY GEGNWSKILLHYKFNNRTSVMLKDRWRTMKKLKLISSDSED | 58 |
| TRF2 | MAAGAGTAGPASGPGVVRDPAASQPRKRPGREGGEGARRSDTMAGGGGSSDGSGRAAGRRASR SSGRARRGRHEPGLGGPAERGAGEARLEEAVNRWVLKFYFHEALRAFRGSRYGDFRQIRDIMQ ALLVRPLGKEHTVSRLLRVMQCLSRIEEGENLDCSFDMEAELTPLESAINVLEMIKTEFTLTE AVVESSRKLVKEAAVIICIKNKEFEKASKILKKHMSKDPTTQKLRNDLLNIIREKNLAHPVIQ NFSYETFQQKMLRFLESHLDDAEPYLLTMAKKALKSESAASSTGKEDKQPAPGPVEKPPREPA RQLRNPPTTIGMMTLKAAFKTLSGAQDSEAAFAKLDQKDLVLPTQALPASPALKNKRPRKDEN ESSAPADGEGGSELQPKNKRMTISRLVLEEDSQSTEPSAGLNSSQEAASAPPSKPTVLNQPLP GEKNPKVPKGKWNSSNGVEEKETWVEEDELFQVQAAPDEDSTTNITKKQKWTVEESEWVKAGV QKYGEGNWAAISKNYPFVNRTAVMIKDRWRTMKRLGMN | 59 |

In another embodiment, the RMEM is not a telomeric protein.

In another embodiment, the RMEM is not a transcription activator.

Recombinant Proteins

In one embodiment, the RMEM is a recombinant protein. In one embodiment, the recombinant protein is XRCC2, RecA, or RadA. Exemplary recombinant proteins are provided in Table 6 and are further described below.

TABLE 6

Recombinant Proteins

| Name | Sequence | SEQ ID NO: |
|---|---|---|
| XRCC2 | MCSAFHRAESGTELLARLEGRSSLKEIEPNLFADEDSPVHGDILEFHGPEG TGKTEMLYHLTARCILPKSEGGLEVEVLFIDTDYHFDMLRLVTILEHRLSQ SSEEIIKYCLGRFFLVYCSSSTHLLLTLYSLESMFCSHPSLCLLILDSLSAFY WIDRVNGGESVNLQESTLRKCSQCLEKLVNDYRLVLFATTQTIMQKASSS SEEPSHASRRLCDVDIDYRPYLCKAWQQLVKHRMFFSKQDDSQSSNQFS LVSRCLKSNSLKKHFFIIGESGVEFC | 60 |
| RecA | MAIDENKQKALAAALGQIEKQFGKGSIMRLGEDRSMDVETISTGSLSLDIALGAGGLPMGRIV EIYGPESSGKTTLTLQVIAAAQREGKTCAFIDAEHALDPIYARKLGVDIDNLLCSQPDTGEQA LEICDALARSGAVDVIVVDSVAALTPKAEIEGEIGDSHMGLAARMMSQAMRKLAGNLKQSNTL LIFINQIRMKIGVMFGNPETTTGGNALKFYASVRLDIRRIGAVKEGENVVGSETRVKVVKNKI AAPFKQAEFQILYGEGINFYGELVDLGVKEKLIEKAGAWYSYKGEKIGQGKANATAWLKDNPE TAKEIEKKVRELLLSNPNSTPDFSVDDSEGVAETNEDF | 61 |
| RadA | MAKAPKRAFVCNECGADYPRWQGQCSACHAWNTITEVRLAASPMVARNERLSGYAGSAGVAKV QKLSDISLEELPRFSTGFKEFDRVLGGGVVPGSAILIGGNPGAGKSTLLLQTLCKLAQQMKTL YVTGEESLQQVAMRAHRLGLPTDNLNMLSETSIEQICLIAEEEQPKLMVIDSIQVMHMADVQS SPGSVAQVRETAAYLTRFAKTRGVAIVMVGHVTKDGSLAGPKVLEHCIDCSVLLDGDADSRFR TLRSHKNRFGAVNELGVFAMTEQGLREVSNPSAIFLSRGDEVTSGSSVMVVWEGTRPLLVEIQ ALVDHSMMANPRRVAVGLEQNRLAILLAVLHRHGGLQMADQDVFVNVVGGVKVTETSADLALL LAMVSSLRDRPLPQDLVVFGEVGLAGEIRPVPSGQERISEAAKHGFRRAIVPAANVPKKAPEG MQIFGVKKLSDALSVFDDL | 62 |
| Rad52 | >sp\|P43351\|RAD52_HUMAN DNA repair protein RAD52 homolog OS = Homo sapiens GN = RAD52 PE = 1 SV = 1<br>MSGTEEAILGGRDSHPAAGGGSVLCFGQCQYTAEEYQAIQKALRQRLGPEYISSRMAGGG QKVCYIEGHRVINLANEMFGYNGWAHSITQQNVDFVDLNNGKFYVGVCAFVRVQLKDGSY HEDVGYGVSEGLKSKALSLEKARKEAVTDGLKRALRSFGNALGNCILDKDYLRSLNKLPR QLPLEVDLTKAKRQDLEPSVEEARYNSCRPNMALGHPQLQQVTSPSRPSHAVIPADQDCS SRSLSSSAVESEATHQRKLRQKLQQQFRERMEKQQVRVSTPSAEKSEAAPPAPPVTHST PVTVSEPLLEKDFLAGVTQELIKTLEDNSEKWAVTPDAGDGVVKPSSRADPAQTSDTLAL NNQMVTQNRTPHSVCHQKPQAKSGSWDLQTYSADQRTTGNWESHRKSQDMKKRKYDPS<br>>sp\|P43351-2\|RAD52_HUMAN Isoform beta of DNA repair protein RAD52 homolog OS = Homo sapiens GN = RAD52<br>MSGTEEAILGGRDSHPAAGGGSVLCFGQCQYTAEEYQAIQKALRQRLGPEYISSRMAGGG QKVCYIEGHRVINLANEMFGYNGWAHSITQQNVDFVDLNNGKFYVGVCAFVRVQLKDGSY HEDVGYGVSEGLKSKALSLEKARKEAVTDGLKRALRLPLLGVSGRILYSLFSVHSVMCAG GLPTPTASAQTAPSSPCSSAVLRYAQEFWECTWKLYSGQRLPEITK | 63 |

TABLE 6-continued

Recombinant Proteins

| Name | Sequence | SEQ ID NO: |
|---|---|---|
| | >sp\|P43351-3\|RAD52_HUMAN Isoform gamma of DNA repair protein RAD52 homolog OS = Homo sapiens GN = RAD52<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVDFVDLNNGKFYVGVCAFVRVQLKVRGW<br>SRPAARKDQWVVGEGWFIS<br>>sp\|P43351-4\|RAD52_HUMAN Isoform delta of DNA repair protein RAD52 homolog OS = Homo sapiens GN = RAD52<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVGEYALQQWGLLHCPAPAESLLWVRR | |
| Rad52-yeast | >RAD52 YML032C SGDID: S000004494<br>MNEIMDMDEKKPVFGNHSEDIQTKLDKKLGPEYISKRVGFGTSRIAYIEGWRVINLANQI<br>FGYNGWSTEVKSVVIDFLDERQGKFSIGCTAIVRVTLTSGTYREDIGYGTVENERRKPAA<br>FERAKKSAVTDALKRSLRGFGNALGNCLYDKDFLAKIDKVKFDPPDFDENNLFRPTDEIS<br>ESSRTNTLHENQEQQQYPNKRRQLTKVTNTNPDSTKNLVKIENTVSRGTPMMAAPAEANS<br>KNSSNKDTDLKSLDASKQDQDDLLDDSLMFSDDFQDDDLINMGNTNSNVLTTEKDPVVAK<br>QSPTASSNPEAEQITFVTAKAATSVQNERYIGEESIFDPKYQAQSIRHTVDQTTSKHIPA<br>SVLKDKTMTTARDSVYEKFAPKGKQLSMKNNDKELGPHMLEGAGNQVPRETTPIKTNATA<br>FPPAAAPRFAPPSKVVHPNGNGAVPAVPQQRSTRREVGRPKINPLHARKPT* | 64 |
| RPA-4 subunit | MSKSGFGSYGSISAADGASGGSDQLCERDATPAIKTQRPKVRIQDVVPCNVQLLSSTVFDPV<br>PKVRGIIVSQVSIVGVIRGAEKASNHICYKIDDMTAKPIEARQWFGREKVKQVTPLSVGVYVK<br>VFGILKCPTGTKSLEVLKIHVLEDMNEFTVHILETVNAHMMLDKARRDTTVESVPVSPSEVND<br>AGDNDESHRNFIQDEVLRLIHECPHQEGKSIHELRAQLCDLSVKAIKEAIDYLTVEGHIYPTV<br>DREHFKSAD | 65 |
| BRCA2 | MPIGSKERPTFFEIFKTRCNKADLGPISLNWFEELSSEAPPYNSEPAEESEHKNNNYEPNLFK<br>TPQRKPSYNQLASTPIIFKEQGLTLPLYQSPVKELDKFKLDLGRNVPNSRHKSLRTVKTKMDQ<br>ADDVSCPLLNSCLSESPVVLQCTHVTPQRDKSVVCGSLFHTPKFVKGRQTPKHISESLGAEVD<br>PDMSWSSSLATPPTLSSTVLIVRNEEASETVFPHDTTANVKSYFSNHDESLKKNDRFIASVTD<br>SENTNQREAASHGFGKTSGNSFKVNSCKDHIGKSMPNVLEDEVYETVVDTSEEDSFSLCFSKC<br>RTKNLQKVRTSKTRKKIFHEANADECEKSKNQVKEKYSFVSEVEPNDTDPLDSNVANQKPFES<br>GSDKISKEVVPSLACEWSQLTLSGLNGAQMEKIPLLHISSCDQNISEKDLLDTENKRKKDFLT<br>SENSLPRISSLPKSEKPLNEETVVNKRDEEQHLESHTDCILAVKQAISGTSPVASSFQGIKKS<br>IFRIRESPKETFNASFSGHMTDPNFKKETEASESGLEIHTVCSQKEDSLCPNLIDNGSWPATT<br>TQNSVALKNAGLISTLKKKTNKFIYAIHDETSYKGKKIPKDQKSELINCSAQFEANAFEAPLT<br>FANADSGLLHSSVKRSCSQNDSEEPTLSLTSSFGTILRKCSRNETCSNNTVISQDLDYKEAKC<br>NKEKLQLFITPEADSLSCLQEGQCENDPKSKKVSDIKEEVLAAACHPVQHSKVEYSDTDFQSQ<br>KSLLYDHENASTLILTPTSKDVLSNLVMISRGKESYKMSDLKGNNYESDVELTKNIPMEKNQ<br>DVCALNENYKNVELLPPEKYMRVASPSRKVQFNQNTNLRVIQKNQEETTSISKITVNPDSEEL<br>FSDNENNFVFQVANERNNLALGNTKELHETDLTCVNEPIFKNSTMVLYGDTGDKQATQVSIK<br>DLVYVLAEENKNSVKQHIKMTLGQDLKSDISLNIDKIPEKNNDYMNKWAGLLGPISNHSFGGS<br>FRTASNKEIKLSEHNIKKSKMFFKDIEEQYPTSLACVEIVNTLALDNQKKLSKPQSINTVSAH<br>LQSSVVVSDCKNSHITPQMLFSKQDFNSNHNLTPSQKAEITELSTILEESGSQFEFTQFRKPS<br>YILQKSTFEVPENQMTILKTTSEECRDADLHVIMNAPSIGQVDSSKQFEGTVEIKRKFAGLLK<br>NDCNKSASGYLTDENEVGFRGFYSAHGTKLNVSTEALQKAVKLFSDIENISEETSAEVHPISL<br>SSSKCHDSVVSMFKIENHNDKTVSEKNNKCQLILQNNIEMTTGTFVEEITENYKRNTENEDNK<br>YTAASRNSHNLEFDGSDSSKNDTVCIHKDETDLLFTDQHNICLKLSGQFMKEGNTQIKEDLSD<br>LTFLEVAKAQEACHGNTSNKEQLTATKTEQNIKDFETSDTFFQTASGKNISVAKESFNKIVNF<br>FDQKPEELHNFSLNSELHSDIRKNKMDILSYEETDIVKHKILKESVPVGTGNQLVTFQGQPER<br>DEKIKEPTLLGFHTASGKKVKIAKESLDKVKNLFDEKEQGTSEITSFSHQWAKTLKYREACKD<br>LELACETIEITAAPKCKEMQNSLNNDKNLVSIETVVPPKLLSDNLCRQTENLKTSKSIFLKVK<br>VHENVEKETAKSPATCYTNQSPYSVIENSALAFYTSCSRKTSVSQTSLLEAKKWLREGIFDGQ<br>PERINTADYVGNYLYENNSNSTIAENDKNHLSEKQDTYLSNSSMSNSYSYHSDEVYNDSGYLS<br>KNKLDSGIEPVLKNVEDQKNTSFSKVISNVKDANAYPQTVNEDICVEELVTSSSPCKNKNAAI<br>KLSISNSNNFEVGPPAFRIASGKIVCVSHETIKKVKDIFTDSFSKVIKENNENKSKICQTKIM<br>AGCYEALDDSEDILHNSLDNDECSTHSHKVFADIQSEEILQHNQNMSGLEKVSKISPCDVSLE<br>TSDICKCSIGKLHKSVSSANTCGIFSTASGKSVQVSDASLQNARQVFSEIEDSTKQVFSKVLF<br>KSNEHSDQLTREENTAIRTCPEHLISQKGFSYNVVNSSAFSGFSTASGKQVSILESSLHKVKGV<br>LEEFDLIRTEHSLHYSPTSRQNVSKILPRVDKRNPEHCVNSEMEKTCSKEFKLSNNLNVEGGS<br>SENNHSIKVSPYLSQFQQDKQQLVLGTKVSLVENIHVLGKEQASPKNVKMEIGKTETFSDVPV<br>KTNIEVCSTYSKDSENYFETEAVEIAKAFMEDDELTDSKLPSHATHSLFTCPENEEMVLSNSR<br>IGKRRGEPLILVGEPSIKRNLLNEFDRIIENQEKSLKASKSTPDGTIKDRRLFMHHVSLEPIT<br>CVPFRTTKERQEIQNPNFTAPGQEFLSKSHLYEHLTLEKSSSNLAVSGHPFYQVSATRNEKMR<br>HLITTGRPTKVFVPPFKTKSHFHRVEQCVRNINLEENRQKQNIDGHGSDDSKNKINDNEIHQF<br>NKNNSNQAVAVTFTKCEEEPLDLITSLQNARDIQDMRIKKKQRQRVFPQPGSLYLAKTSTLPR<br>ISLKAAVGGQVPSACSHKQLYTYGVSKHCIKINSKNAESFQFHTEDYFGKESLWTGKGIQLAD<br>GGWLIPSNDGKAGKEEFYRALCDTPGVDPKLISRIWVYNHYRWIIWKLAAMECAFPKEFANRC<br>LSPERVLLQLKYRYDTEIDRSRRSAIKKIMERDDTAAKTLVLCVSDIISLSANISETSSNKTS<br>SADTQKVAIIELTDGWYAVKAQLDPPLLAVLKNGRLTVGQKIILHGAELVGSPDACTPLEAPE<br>SLMLKISANSTRPARWYTKLGFFPDPRPFPLPSSLFSDGGNVGCVDVIIQRAYPIQWMEKTS<br>SGLYIFRNEREEEKEAAKYVEAQQKRLEALFTKIQEEFEEHEENTTKPYLPSRALTRQQVRAL<br>QDGAELYEAVKNAADPAYLEGYFSEEQLRALNNHRQMLNDKKQAQIQLEIRKAMESAEQKEQG<br>LSRDVTTVWKLRIVSYSKKEKDSVILSIWRPSSDYLSLLTEGKRYRIYHLATSKSKSKSERAN<br>IQLAATKKTQYQQLPVSDEILFQIYQPREPLHFSKFLDPDFQPSCSEVDLIGFVVSVVKKTGL | 66 |

TABLE 6-continued

Recombinant Proteins

| Name | Sequence | SEQ ID NO: |
|---|---|---|
| | APFVYLSDECYNLLAIKFWIDLNEDIIKPHMLIAASNLQWRPESKSGLLTLFAGDFSVFSASP<br>KEGHFQETFNKMKNTVENIDILCNEAENKLMHILHANDPKWSTPTKDCTSGPYTAQIIPGTGN<br>KLLMSSPNCEIYYQSPLSLCMAKRKSVSTPVSAQMTSKSCKGEKEIDDQKNCKKRRALDFLSR<br>LPLPPPVSPICTFVSPAAQKAFQPPRSCGTKYETPIKKKELNSPQMTPFKKFNEISLLESNSI<br>ADEELALINTQALLSGSTGEKQFISVSESTRTAPTSSEDYLRLKRRCTTSLIKEQESSQASTE<br>ECEKNKQDTITTKKYI (breast cancer 2, early onset, isoform CRA_c<br>[Homo sapiens] CCDS 9344.1) | |
| SHFM1 | \|NP_006295.1\|26S proteasome complex subunit DSS1 [Homo sapiens]<br>MSEKKQPVDLGLLEEDDEFEEFPAEDWAGLDEDEDAHVWEDNWDDDNVEDDFSNQLRAELEKH<br>GYKMETS | 67 |
| PALB2 | \|ref\|NP_078951.2\|partner and localizer of BRCA2 [Homo sapiens]<br>MDEPPGKPLSCEEKEKLKEKLAFLKREYSKTLARLQRAQRAEKIKHSIKKTVEEQDCLSQQDL<br>SPQLKHSEPKNKICVYDKLHIKTHLDEETGEKTSITLDVGPESFNPGDGPGGLPIQRTDDTQE<br>HFPHRVSDPSGEQKQKLPSRRKKQQKRTFISQERDCVFGTDSLRLSGKRLKEQEEISSKNPAR<br>SPVTEIRTHLLSLKSELPDSPEPVTEINEDSVLIPPTAQPEKGVDTFLRRPNFTRATTVPLQT<br>LSDSGSSQHLEHIPPKGSSELTTHDLKNIRFTSPVSLEAQGKKMTVSTDNLLVNKAISKSGQL<br>PTSSNLEANISCSLNELTYNNLPANENQNLKEQNQTEKSLKSPSDTLDGRNENLQESEILSQP<br>KSLSLEATSPLSAEKHSCTVPEGLLFPAEYYVRTTRSMSNCQRKVAVEAVIQSHLDVKKKGFK<br>NKNKDASKNLNLSNEETDQSEIRMSGTCTGQPSSRTSQKLLSLTKVSSPAGPTEDNDLSRKAV<br>AQAPGRRYTGKRKSACTPASDHCEPLLPTSSLSIVNRSKEEVTSHKYQHEKLFIQVKGKKSRH<br>QKEDSLSWSNSAYLSLDDDAFTAPPHRDGMLSLKQLLSFLSITDFQLPDEDFGPLKLEKVKSC<br>SEKPVEPFESKMFGERHLKEGSCIFPEELSPKRMDTEMEDLEEDLIVLPGKSHPKRPNSQSQH<br>TKTGLSSSILLYTPLNTVAPDDNDRPTTDMCSPAFPILGTTPAFGPQGSYEKASTEVAGRTCC<br>TPQLAHLKDSVCLASDTKQFDSSGSPAKPHTTLQVSGRQGQPTCDCDSVPPGTPPPIESFTFK<br>ENQLCRNTCQELHKHSVEQTETAELPASDSINPGNLQLVSELKNPSGSCSVDVSAMFWERAGC<br>KEPCIITACEDVVSLWKALDAWQWEKLYTWHFAEVPVLQIVPVPDVYNLVCVALGNLEIREIR<br>ALFCSSDDESEKQVLLKSGNIKAVLGLTKRRLVSSSGTLSDQQVEVMTFAEDGGGKENQFLMP<br>PEETILTFAEVQGMQEALLGTTIMNNIVIWNLKTGQLLKKMHIDDSYQASVCHKAYSEMGLLF<br>IVLSHPCAKESESLRSPVFQLIVINPKTTLSVGVMLYCLPPGQAGRFLEGDVKDHCAAAILTS<br>GTIAIWDLLLGQCTALLPPVSDQHWSFVKWSGTDSHLLAGQKDGNIFVYHYS | 68 |
| Rad51 | MAMQMQLEANADTSVEEESFGPQPISRLEQCGINANDVKKLEEAGFHTVEAVAYAPKKELINI<br>KGISEAKADKILAEAAKLVPMGFTTATEFHQRRSEIIQITTGSKELDKLLQGGIETGSITEMF<br>GEFRTGKTQICHTLAVTCQLPIDRGGGEGKAMYIDTEGTFRPERLLAVAERYGLSGSDVLDNV<br>AYARAFNTDHQTLLYQASAMMVESRYALLIVDSATALYRTDYSGRGELSARQMHLARFLRML<br>LRLADEFGVAVVITNQVVAQVDGAAMFAADPKKPIGGNIIAHASTTRLYLRKGRGETRICKIY<br>DSPCLPEAEAMFAINADGVGDAKD (RAD51 [Homo sapiens], CCDS 10062.1)<br>MAMQMQLEANADTSVEEESFGPQPISRLEQCGINANDVKKLEEAGFHTVEAVAYAPKKELINI<br>KGISEAKADKILTESRSVARLECNSVILVYCTLRLSGSSDSPASASRVVGTTGGIETGSITEM<br>FGEFRTGKTQICHTLAVTCQLPIDRGGGEGKAMYIDTEGTFRPERLLAVAERYGLSGSDVLDN<br>VAYARAFNTDHQTLLYQASAMMVESRYALLIVDSATALYRTDYSGRGELSARQMHLARFLRM<br>LLRLADEFGVAVVITNQVVAQVDGAAMFAADPKKPIGGNIIAHASTTRLYLRKGRGETRICKI<br>YDSPCLPEAEAMFAINADGVGDAKD (RAD51 [Homo sapiens], CCDS 53931.1)<br>MAMQMQLEANADTSVEEESFGPQPISRLEQCGINANDVKKLEEAGFHTVEAVAYAPKKELINI<br>KGISEAKADKILAEAAKLVPMGFTTATEFHQRRSEIIQITTGSKELDKLLQGGIETGSITEMF<br>GEFRTGKTQICHTLAVTCQLPIDRGGGEGKAMYIDTEGTFRPERLLAVAERYGLSGSDVLDNV<br>AYARAFNTDHQTLLYQASAMMVESRYALLIVDSATALYRTDYSGRGELSARQMHLARFLRML<br>LRLADEIVSEERKRGNQNLQNLRLSLSS (CCDS 53932.1) | 69 |
| Rad51B | >gi\|10835029\|ref\|NP_002868.1\|DNA repair protein RAD51 homolog<br>2 isoform 1 [Homo sapiens]<br>MGSKKLKRVGLSQELCDRLSRHQILTCQDFLCLSPLELMKVTGLSYRGVHELLCMVSRACAPK<br>MQTAYGIKAQRSADFSPAFLSTTLSALDEALHGGVACGSLTEITGPPGCGKTQFCIMMSILAT<br>LPTNMGGLEGAVVYIDTESAFSAERLVEIAESRFPRYFNTEEKLLLTSSKVHLYRELTCDEVL<br>QRIESLEEEIISKGIKLVILDSVASVVRKEFDAQLQGNLKERNKFLAREASSLKYLAEEFSIP<br>VILTNQITTHLSGALASQADLVSPADDLSLSEGTSGSSCVIAALGNTWSHSVNTRLILQYLDS<br>ERRQILIAKSPLAPFTSFVYTIKEEGLVLQAYGNS<br>>gi\|19924117\|ref\|NP_598194.1\|DNA repair protein RAD51 homolog<br>2 isoform 2 [Homo sapiens]<br>MGSKKLKRVGLSQELCDRLSRHQILTCQDFLCLSPLELMKVTGLSYRGVHELLCMVSRACAPK<br>MQTAYGIKAQRSADFSPAFLSTTLSALDEALHGGVACGSLTEITGPPGCGKTQFCIMMSILAT<br>LPTNMGGLEGAVVYIDTESAFSAERLVEIAESRFPRYFNTEEKLLLTSSKVHLYRELTCDEVL<br>QRIESLEEEIISKGIKLVILDSVASVVRKEFDAQLQGNLKERNKFLAREASSLKYLAEEFSIP<br>VILTNQITTHLSGALASQADLVSPADDLSLSEGTSGSSCVIAALGNTWSHSVNTRLILQYLDS<br>ERRQILIAKSPLAPFTSFVYTIKEEGLVLQGQEKP<br>>gi\|46255039\|ref\|NP_598193.2\|DNA repair protein RAD51 homolog<br>2 isoform 3 [Homo sapiens]<br>MGSKKLKRVGLSQELCDRLSRHQILTCQDFLCLSPLELMKVTGLSYRGVHELLCMVSRACAPK<br>MQTAYGIKAQRSADFSPAFLSTTLSALDEALHGGVACGSLTEITGPPGCGKTQFCIMMSILAT<br>LPTNMGGLEGAVVYIDTESAFSAERLVEIAESRFPRYFNTEEKLLLTSSKVHLYRELTCDEVL<br>QRIESLEEEIISKGIKLVILDSVASVVRKEFDAQLQGNLKERNKFLAREASSLKYLAEEFSIP<br>VILTNQITTHLSGALASQADLVSPADDLSLSEGTSGSSCVIAALGNTWSHSVNTRLILQYLDS | 70 |

TABLE 6-continued

Recombinant Proteins

| Name | Sequence | SEQ ID NO: |
|---|---|---|
| | ERRQILIAKSPLAPFTSFVYTIKEEGLVLQETTFCSVTQAELNWAPEILPPQPPEQLGLQMCH<br>HTQLIF | |
| Rad51C | >gi\|17402896\|ref\|NP_478123.1\|DNA repair protein RAD51 homolog<br>3 isoform 1 [Homo sapiens]<br>MRGKTFRFEMQRDLVSFPLSPAVRVKLVSAGFQTAEELLEVKPSELSKEVGISKAEALETLQI<br>IRRECLTNKPRYAGTSESHKKCTALELLEQEHTQGFIITFCSALDDILGGGVPLMKTTEICGA<br>PGVGKTQLCMQLAVDVQIPECFGGVAGEAVFIDTEGSFMVDRVVDLATACIQHLQLIAEKHKG<br>EEHRKALEDFTLDNILSHIYYFRCRDYTELLAQVYLLPDFLSEHSKVRLVIVDGIAFPFRHDL<br>DDLSLRTRLLNGLAQQMISLANNHRLAVILTNQMTTKIDRNQALLVPALGESWGHAATIRLIF<br>HWDRKQRLATLYKSPSQKECTVLFQIKPQGFRDTVVTSACSLQTEGSLSTRKRSRDPEEEL<br>>gi\|4506391\|ref\|NP_002867.1\|DNA repair protein RAD51 homolog 3<br>isoform 2 [Homo sapiens]<br>MRGKTFRFEMQRDLVSFPLSPAVRVKLVSAGFQTAEELLEVKPSELSKEVGISKAEALETLQI<br>IRRECLTNKPRYAGTSESHKKCTALELLEQEHTQGFIITFCSALDDILGGGVPLMKTTEICGA<br>PGVGKTQLW | 71 |
| XRCC3 | >gi\|153946430\|ref\|NP_001093589.1\|DNA repair protein XRCC3<br>[Homo sapiens]<br>MDLDLLDLNPRIIAAIKKAKLKSVKEVLHFSGPDLKRLTNLSSPEVWHLLRTASLHLRGSSIL<br>TALQLHQQKERFPTQHQRLSLGCPVLDALLRGGLPLDGITELAGRSSAGKTQLALQLCLAVQF<br>PRQHGGLEAGAVYICTEDAFPHKRLQQLMAQQPRLRTDVPGELLQKLRFGSQIFIEHVADVDT<br>LLECVNKKVPVLLSRGMARLVVIDSVAAPFRCEFDSQASAPRARHLQSLGATLRELSSAFQSP<br>VLCINQVTEAMEEQGAAHGPLGFWDERVSPALGITWANQLLVRLLADRLREEEAALGCPARTL<br>RVLSAPHLPPSSCSYTISAEGVRGTPGTQSH | 72 |

In another embodiment, the recombinant protein is not Rad52, Rad52 yeast, RPA-4 subunit, BRCA2, SHFM1, PALB2, XRCC3, Rad51, Rad51B, or Rad51C. In another embodiment, the RMEM is not a recombinant protein. In one embodiment, the RMEM is not Rad52. In one embodiment, the RMEM is not Rad51. In another embodiment, the RMEM is not Rad51 or Rad52.

In another embodiment, the present disclosure provides a method of suppressing the formation of a deletion in a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Rad52, wherein the gRNA molecule and the RNA-guided nuclease molecule interact with the nucleic acid, resulting in a cleavage event, wherein the cleavage event is repaired by at least one DNA repair pathway that is modulated by the RMEM, and wherein the sequence of the nucleic acid after the cleavage event is repaired is different than the sequence of the nucleic acid prior to the cleavage event, thereby suppressing the formation of a deletion in the nucleic acid at the target position in the cell, or in the population of cells. In one embodiment, the formation a deletion is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Rad52, wherein the gRNA molecule and the RNA-guided nuclease molecule interact with the nucleic acid, resulting in a cleavage event, wherein the cleavage event is repaired by at least one DNA repair pathway, and wherein the sequence of the nucleic acid after the cleavage event is repaired is different than the sequence of the nucleic acid prior to the cleavage event, thereby suppressing gene conversion of the nucleic acid at the target position in the cell, or in the population of cells. In one embodiment, the frequency of gene conversion is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Rad51, wherein the gRNA molecule and the RNA-guided nuclease molecule interact with the nucleic acid, resulting in a cleavage event, wherein the cleavage event is repaired by at least one DNA repair pathway, and wherein the sequence of the nucleic acid after the cleavage event is repaired is different than the sequence of the nucleic acid prior to the cleavage event, thereby suppressing gene conversion of the nucleic acid at the target position in the cell, or in the population of cells. In one embodiment, the frequency of gene conversion is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is ERCC1, wherein the gRNA molecule and the RNA-guided nuclease molecule interact with the nucleic acid, resulting in a cleavage event, wherein the cleavage event is repaired by at least one DNA repair pathway, and wherein the sequence of the nucleic acid after the cleavage event is repaired is different than the sequence of the nucleic acid prior to the cleavage event, thereby suppressing gene conversion of the nucleic acid at the target position in the cell, or in the population of cells. In one embodiment, the frequency of gene conversion is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene conversion of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is RPA, wherein the gRNA molecule and the RNA-guided nuclease molecule interact with the nucleic acid, resulting in a cleavage event, wherein the cleavage event is repaired by at least one DNA repair pathway, and wherein the sequence of the nucleic acid after the cleavage event is repaired is different than the sequence of the nucleic acid prior to the cleavage event, thereby suppressing gene conversion of the nucleic acid at the target position in the cell, or in the population of cells. In one embodiment, the frequency of gene conversion is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

In another embodiment, the present disclosure provides a method of suppressing gene correction of a nucleic acid at a target position in a cell, or a population of cells, by contacting the cell, or the population of cells, with (a) a gRNA molecule, (b) a RNA-guided nuclease molecule, and (c) a heterologous Repair-Modulating Enzyme Molecule (RMEM), wherein the RMEM is Rad51, wherein the gRNA molecule and the RNA-guided nuclease molecule interact with the nucleic acid, resulting in a cleavage event, wherein the cleavage event is repaired by at least one DNA repair pathway, and wherein the sequence of the nucleic acid after the cleavage event is repaired is different than the sequence of the nucleic acid prior to the cleavage event, thereby suppressing gene correction of the nucleic acid at the target position in the cell, or in the population of cells. In one embodiment, the frequency of gene correction is decreased (or suppressed) by about 1-fold, by about 1.5-fold, by about 2-fold, by about 2.5-fold, by about 3-fold, by about 3.5-fold, by about 4-fold, by about 4.5-fold, by about 5-fold, by about 5.5-fold, by about 6-fold, by about 6.5-fold, by about 7-fold, by about 7.5-fold, by about 8-fold, by about 8.5-fold, by about 9-fold, by about 9.5-fold, by about 10-fold, by about 10.5-fold, by about 11-fold, by about 11.5-fold, by about 12-fold, by about 12.5-fold, by about 13-fold, by about 13.5-fold, by about 14-fold, by about 14.5-fold, by about 15-fold, by about 16-fold, by about 17-fold, by about 18-fold, by about 19-fold or by about 20-fold.

Histone Acetyltransferases

In one embodiment, a RMEM comprises histone acetyltransferase activity, e.g., is a histone acetyltransferase (HAT). Histone acetyltransferase activity comprises the transfer of an acetyl group from acetyl-CoA to the lysine residue of a histone protein to generate c-N-acetyllysine. Acetylation of the histone modifies the structure of chromatin, and can allow increased accessibility of DNA resection and repair machinery. HATs are typically classified into two classes: type A and type B HATs. Type A HATs are primarily localized in the nucleus, acetylate nucleosomal histones in chromatin, and contain a bromodomain. Type B HATs are primarily localized in the cytoplasm, acetylate newly synthesized histones prior to assembly into chromatin, and lack bromodomains. Based on sequence homology, HATs are grouped into at least 3 different families: GNAT (Gen5-related N-acetyltransferases), MYST (named after its members MOZ, Ybf2 (Sas3), Sas2, and Tip60), and p300/CBP. Members of the GNAT family typically contain bromodomains, and acetylate lysine residues on histones H2B, H3, and H4. Members of the MYST members typically contain zinc fingers and chromodomains, and acetylate lysine residues on histones H2B, H3, and H4. The p300/CBP family includes p300 and CBP.

Exemplary histone acetyltransferases are provided in Table 7 below and are described further below.

TABLE 7

Histone acetyltransferases

| Name | Sequence | SEQ ID NO: |
|---|---|---|
| Tip60/KAT5 Isoform 1 CCDS8110.1 | MAEVVSPVPGAGRREPGEVGRARGPPVADPGVALSPQGEIIEGCRLPVLRRNQDNEDEWP LAEILSVKDISGRKLFYVHYIDFNKRLDEWVTHERLDLKKIQFPKKEAKTPTKNGLPGSR PGSPEREVPASAQASGKTLPIPVQITLRFNLPKEREAIPGGEPDQPLSSSSCLQPNHRST KRKVEVVSPATPVPSETAPASVFPQNGAARRAVAAQPGRKRKSNCLGTDEDSQDSSDGIP SAPRMTGSLVSDRSHDDIVTRMKNIECIELGRHRLKPWYFSPYPQELTTLPVLYLCEFCL KYGRSLKCLQRHLTKCDLRHPPGNEIYRKGTISFFEIDGRKNKSYSQNLCLLAKCFLDHK TLYYDTDPFLFYVMTEYDCKGFHIVGYFSKEKESTEDYNVACILTLPPYQRRGYGKLLIE FSYELSKVEGKTGTPEKPLSDLGLLSYRSYWSQTILEILMGLKSESGERPQITINEISEI TSIKKEDVISTLQYLNLINYYKGQYILTLSEDIVDGHERAMLKRLLRIDSKCLHFTPKDW SKRGKW | 73 |
| Tip60/KAT5 Isoform 2 CCDS 31610.1 | MAEVGEIIEGCRLPVLRRNQDNEDEWPLAEILSVKDISGRKLFYVHYIDFNKRLDEWVTH ERLDLKKIQFPKKEAKTPTKNGLPGSRPGSPEREVPASAQASGKTLPIPVQITLRFNLPK EREAIPGGEPDQPLSSSSCLQPNHRSTKRKVEVVSPATPVPSETAPASVFPQNGAARRAV AAQPGRKRKSNCLGTDEDSQDSSDGIPSAPRMTGSLVSDRSHDDIVTRMKNIECIELGRH RLKPWYFSPYPQELTTLPVLYLCEFCLKYGRSLKCLQRHLTKCDLRHPPGNEIYRKGTIS FFEIDGRKNKSYSQNLCLLAKCFLDHKTLYYDTDPFLFYVMTEYDCKGFHIVGYFSKEKE STEDYNVACILTLPPYQRRGYGKLLIEFSYELSKVEGKTGTPEKPLSDLGLLSYRSYWSQ TILEILMGLKSESGERPQITINEISEITSIKKEDVISTLQYLNLINYYKGQYILTLSEDI VDGHERAMLKRLLRIDSKCLHFTPKDWSKRGKW | 74 |
| Tip60/KAT5 Isoform 3 CCDS 8109.1 | MAEVGEIIEGCRLPVLRRNQDNEDEWPLAEILSVKDISGRKLFYVHYIDFNKRLDEWVTH ERLDLKKIQFPKKEAKTPTKNGLPGSRPGSPEREVKRKVEVVSPATPVPSETAPASVFPQ NGAARRAVAAQPGRKRKSNCLGTDEDSQDSSDGIPSAPRMTGSLVSDRSHDDIVTRMKNI ECIELGRHRLKPWYFSPYPQELTTLPVLYLCEFCLKYGRSLKCLQRHLTKCDLRHPPGNE IYRKGTISFFEIDGRKNKSYSQNLCLLAKCFLDHKTLYYDTDPFLFYVMTEYDCKGFHIV GYFSKEKESTEDYNVACILTLPPYQRRGYGKLLIEFSYELSKVEGKTGTPEKPLSDLGLL SYRSYWSQTILEILMGLKSESGERPQITINEISEITSIKKEDVISTLQYLNLINYYKGQY ILTLSEDIVDGHERAMLKRLLRIDSKCLHFTPKDWSKRGKW | 75 |
| Tip60/KAT5 Isoform 4 CCDS 55771.1 | MAEVVSPVPGAGRREPGEVGRARGPPVADPGVALSPQGEIIEGCRLPVLRRNQDNEDEWP LAEILSVKDISGRKLFYVHYIDFNKRLDEWVTHERLDLKKIQFPKKEAKTPTKNGLPGSR PGSPEREVKRKVEVVSPATPVPSETAPASVFPQNGAARRAVAAQPGRKRKSNCLGTDEDS QDSSDGIPSAPRMTGSLVSDRSHDDIVTRMKNIECIELGRHRLKPWYFSPYPQELTTLPV LYLCEFCLKYGRSLKCLQRHLTKCDLRHPPGNEIYRKGTISFFEIDGRKNKSYSQNLCLL AKCFLDHKTLYYDTDPFLFYVMTEYDCKGFHIVGYFSKEKESTEDYNVACILTLPPYQRR GYGKLLIEFSYELSKVEGKTGTPEKPLSDLGLLSYRSYWSQTILEILMGLKSESGERPQI TINEISEITSIKKEDVISTLQYLNLINYYKGQYILTLSEDIVDGHERAMLKRLLRIDSKC LHFTPKDWSKRGKW | 76 |
| HAT1 CCDS 2245.1 | MAGFGAMEKFLVEYKSAVEKKLAEYKCNTNTAIELKLVRFPEDLENDIRTFFPEYTHQLF GDDETAFGYKGLKILLYYIAGSLSTMFRVEYASKVDENFDCVEADDVEGKIRQIIPPGFC TNTNDFLSLLEKEVDFKPFGTLLHTYSVLSPTGGENFTFQIYKADMTCRGFREYHERLQT FLMWFIETASFIDVDDERWHYFLVFEKYNKDGATLFATVGYMTVYNYVVYPDKTRPRVSQ MLILTPFQGQGHGAQLLETVHRYYTEFPTVLDITAEDPSKSYVKLRDFVLVKLCQDLPCF SREKLMQGFNEDMVIEAQQKFKINKQHARRVYEILRLLVTDMSDAEQYRSYRLDIKRRLI SPYKKKQRDLAKMRKCLRPEELTNQMNQIEISMQHEQLEESFQELVEDYRRVIERLAQE | 77 |

K(lysine) acetyltransferase 5 (Tip60/KAT5, hereinafter "Tip60"), also known as histone acetyltransferase HTATIP (HIV-1 Tat interactive protein), is a member of the MYST family and acetylates histones (primarily histones H4 at lysines at position 5, 12, and 16, and H2A) and nonhistone proteins. Tip60 plays a role in regulating chromatin remodeling. Tip60 is recruited to double strand breaks and inhibits 53BP1 association (see, e.g., Tang et al. (2013) NAT. STRUCT. MOL. BIOL. 20(3): 317-25). Use of a Tip60 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of repair seen with an RNA-guided nuclease, e.g., Cas9 molecule, in the absence of increased expression of an endogenous Tip60 RMEM and/or overexpression of a heterologous Tip60 RMEM. Candidate Tip60 RMEMs can be evaluated for c-NHEJ, alt-NHEJ (including blunt EJ, MMEJ, and SD-MMEJ), and HDR (including alt-HR, HR, and SSA) by using any of the functional assays described herein.

Histone acetyltransferase 1 (HAT) is a type B histone acetyltransferase that acetylates newly synthesized cytoplasmic histones, primarily histone H4 (at lysines at positions 5 and 12) and H2A, but in some contexts histone H3, before their translocation to the nucleus and deposition onto nascent DNA. HAT1-mediated acetylation plays an important role in repair of DNA damage, particularly homologous directed repair. HAT1 is recruited to double strand breaks and recruits RAD51 (see, e.g., Yang et al. J. Biol. Chem. 288(25): 18271-82). Use of a HAT1 RMEM in combination with a Cas9 molecule in the methods as described herein can increase HDR as compared to the level of repair seen with a Cas9 molecule in the absence of increased expression of an endogenous HAT1 RMEM and/or overexpression of a heterologous HAT1 RMEM. Candidate HAT1 RMEMs can be evaluated for HDR by using a functional assays described herein.

In another embodiment, the RMEM is not a histone acetylase. In another embodiment, the histone acetylase is not Tip60/KAT5.

Histone Deacetylases

In one embodiment, a RMEM comprises histone deacetylase activity, e.g., is a histone deacetylase (HDAC). Histone deacetylase activity comprises the removal of the acetyl group from an e-N-acetyllysine on a histone. Deacetylation of the histone modifies the structure of chromatin, modulates the accessibility of DNA resection and repair machinery. HDACs are classified into Class I, IIA, IIB, III, and IV based on function and sequence homology. Class I and Class II HDACs can be inhibited by trichostatin A (TSA). Class III HDACs are NAD+-dependent enzymes that are not inhibited by TSA.

Exemplary histone deacetylases are provided in Table 8 below and are described further below.

activity. SIRT6 deacetylates acetyllysines in histone H3, e.g., acetyllysines at amino acid position 9 and 56, SIRT6 is recruited to sites of double strand breaks and stimulates repair. SIRT6-mediated deacetylation may recruit CtIP at the lesion, thereby increasing resection. (Kaidi et al. (2010) SCIENCE 329(5997): 1348-53). Use of a SIRT6 RMEM in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous SIRT6 RMEM and/or overexpression of a heterologous SIRT6 RMEM. Candidate SIRT6 RMEMs can be evaluated for c-NHEJ, alt-NHEJ (including blunt EJ, MMEJ, and SD-MMEJ), and HDR (including alt-HR, HR, and SSA) by using any of the functional assays described herein, e.g., in Section VIII.

In another embodiment, the RMEM is not a histone deacetylase.

Histone Methyltransferases

In one embodiment, a RMEM comprises histone methyltransferase activity, e.g., is a histone methyltransferase (HMT). Histone methyltransferase activity comprises the transfer of one, two or three methyl groups to a lysine or arginine residue of a histone protein. Histone methyltransferase activity can be lysine or arginine-specific. Methylation of the histone modifies the structure of chromatin, and can allow increased accessibility of DNA resection and repair machinery. HMTs are subdivided into SET domain-containing and non-SET domain-containing enzymes. SET domain-containing HMTs include a SET domain, a pre-SET domain, and a post-SET domain, where the pre-SET domain and the post-SET domain flank the SET domain. Non-SET domain-containing HMTs utilize the Dot1 enzyme.

TABLE 8

Histone deacetylases

| Name | Sequence | SEQ ID NO: |
|---|---|---|
| SIRT6 Isoform 1 CCDS 12122.1 | MSVNYAAGLSPYADKGKCGLPEIFDPPEELERKVWELARLVWQSSSVVFHTGAGISTASG IPDFRGPHGVWTMEERGLAPKFDTTFESARPTQTHMALVQLERVGLLRFLVSQNVDGLHV RSGFPRDKLAELHGNMFVEECAKCKTQYVRDTVVGTMGLKATGRLCTVAKARGLRACRGE LRDTILDWEDSLPDRDLALADEASRNADLSITLGTSLQIRPSGNLPLATKRRGGRLVIVN LQPTKHDRHADLRIHGYVDEVMTRLMKHLGLEIPAWDGPRVLERALPPLPRPPTPKLEPK EESPT | 78 |
| SIRT6 Isoform 2 CCDS 54199.1 | MSVNYAAGLSPYADKGKCGLPEIFDPPEELERKVWELARLVWQSSSVVFHTGAGISTASG IPDFRGPHGVWTMEERGLAPKFDTTFESARPTQTHMALVQLERVGLLRFLVSQNVDGLHV RSGFPRDKLAELHGNMFVEECAKCKTQYVRDTVVGTMGLKATGRLCTVAKARGLRACRNA DLSITLGTSLQIRPSGNLPLATKRRGGRLVIVNLQPTKHDRHADLRIHGYVDEVMTRLMK HLGLEIPAWDGPRVLERALPPLPRPPTPKLEPKEESPTRINGSIPAGPKQEPCAQHNGSE PASPKRERPTSPAPHRPPKRVKAKAVPS | 79 |

Sirtuin 6 (SIRT6), also known as Sir2-related protein type 6, has histone deacetylase and mono-ADP ribosyltransferase Exemplary histone methyltransferases are provided in Table 9 below and are described further below.

TABLE 9

Histone methyltransferases

| Name | Sequence | SEQ ID NO: |
|---|---|---|
| SETD2 Isoform 1 | MKQLQPQPPPKMGDFYDPEHPTPEEEENEAKIENVQKTGFIKGPMFKGVASSRFLPKGTK TKVNLEEQGRQKVSFSFSLTKKTLQNRFLTALGNEKQSDTPNPPAVPLQVDSTPKMKMEI GDTLSTAEESSPPKSRVELGKIHFKKHLLHVTSRPLLATTTAVASPPTHAAPLPAVIAES TTVDSPPSSPPPPPPPAQATTLSSPAPVTEPVALPHTPITVLMAAPVPLPVDVAVRSLKE PPIIIVPESLEADTKQDTISNSLEEHVTQILNEQADISSKKEDSHIGKDEEIPDSSKISL SCKKTGSKKKSSQSEGIFLGSESDEDSVRTSSSQRSHDLKFSASIEKERDFKKSSAPLKS EDLGKPSRSKTDRDDKYFSYSKLERDTRYVSSRCRSERERRRSRSHSRSERGSRTNLSYS RSERSHYYDSDRRYHRSSPYRERTRYSRPYTDNRARESSDSEEEYKKTYSRRTSSHSSSY RDLRTSSYSKSDRDCKTETSYLEMERRGKYSSKLERESKRTSENEAIKRCCSPPNELGFR RGSSYSKHDSSASRYKSTLSKPIPKSDKFKNSFCCTELNEEIKQSHSFSLQTPCSKGSEL RMINKNPEREKAGSPAPSNRLNDSPTLKKLDELPIFKSEFITHDSHDSIKELDSLSKVKN DQLRSFCPIELNINGSPGAESDLATFCTSKTDAVLMTSDDSVTGSELSPLVKACMLSSNG FQNISRCKEKDLDDTCMLHKKSESPFRETEPLVSPHQDKLMSMPVMTVDYSKTVVKEPVD TRVSCCKTKDSDIYCTLNDSNPSLCNSEAENIEPSVMKISSNSFMNVHLESKPVICDSRN LTDHSKFACEEYKQSIGSTSSASVNHFDDLYQPIGSSGIASSLQSLPPGIKVDSLTLLKC GENTSPVLDAVLKSKKSSEFLKHAGKETIVEVGSDLPDSGKGFASRENRRNNGLSGKCLQ EAQEEGNSILPERRGRPEISLDERGEGGHVHTSDDSEVVFSSCDLNLTMEDSDGVTYALK CDSSGHAPEIVSTVHEDYSGSSESSNDESDSEDTDSDDSSIPRNRLQSVVVVPKNSTLPM EETSPCSSRSSQSYRHYSDHWEDERLESRRHLYEEKFESIASKACPQTDKFFLHKGTEKN PEISFTQSSRKQIDNRLPELSHPQSDGVDSTSHTDVKSDPLGHPNSEETVKAKIPSRQQE ELPIYSSDFEDVPNKSWQQTTFQNRPDSRLGKTELSFSSSCEIPHVDGLHSSEELRNLGW DFSQEKPSTTYQQPDSSYGACGGHKYQQNAEQYGGTRDYWQGNGYWDPRSGRPPGTGVVY DRTQGQVPDSLTDDREEEENWDQQDGSHFSDQSDKFLLSLQKDKGSVQAPEISSNSIKDT LAVNEKKDFSKNLEKNDIKDRGPLKKRRQEIESDSESDGELQDRKKVREVEQGETSVPP GSALVGPSCVMDDFRDPQRWKECAKQGKMPCYFDLIEENVYLTERKKNKSHRDIKRMQCE CTPLSKDERAQGEIACGEDCLNRLLMIECSSRCPNGDYCSNRRFQRKQHADVEVILTEKK GWGLRAAKDLPSNTFVLEYCGEVLDHKEFKARVKEYARNKNIHYYFMALKNDEIIDATQK GNCSRFMNHSCEPNCETQKWTVNGQLRVGFFTTKLVPSGSELTFDYQFQRYGKEAQKCFC GSANCRGYLGGENRVSIRAAGGKMKKERSRKKDSVDGELEALMENGEGLSDKNQVLSLSR LMVRIETLEQKLTCLELIQNTHSQSCLKSFLERHGLSLLWIWMAELGDGRESNQKLQEEI IKTLEHLPIPTKNMLEESKVLPIIQRWSQTKTAVPPLSEGDGYSSENTSRAHTPLNTPDP STKLSTEADTDTPKKLMFRRLKIISENSMDSAISDATSELEGKDGKEDLDQLENVPVEEE EELQSQQLLPQQLPECKVDSETNIEASKLPTSEPEADAEIEPKESNGTKLEEPINEETPS QDEEEGVSDVESERSQEQPDKTVDISDLATKLLDSWKDLKEVYRIPKKSQTEKENTTTER GRDAVGFRDQTPAPKTPNRSRERDPDKQTQNKEKRKRRSSLSPPSSAYERGTKRPDDRYD TPTSKKKVRIKDRNKLSTEERRKLFEQEVAQREAQKQQQQMQNLGMTSPLPYDSLGYNAP HHPFAGYPPGYPMQAYVDPSNPNAGKVLLPTPSMDPVCSPAPYDHAQPLVGHSTEPLSAP PPVPVVPHVAAPVEVSSSQYVAQSDGVVHQDSSVAVLPVPAPGPVQGQNYSVWDSNQQSV SVQQQYSPAQSQATIYYQGQTCPTVYGVTSPYSQTTPPIVQSYAQPSLQYIQGQQIFTAH PQGVVVQPAAAVTTIVAPGQPQPLQPSEMVVTNNLLDLPPPSPPKPKTIVLPPNWKTARD PEGKIYYYHVITRQTQWDPPTWESPGDDASLEHEAEMDLGTPTYDENPMKASKKPKTAEA DTSSELAKKSKEVFRKEMSQFIVQCLNPYRKPDCKVGRITTTEDFKHLARKLTHGVMNKE LKYCKNPEDLECNENVKHKTKEYIKKYMQKFGAVYKPKEDTELE | 80 |
| SETD2 Isoform 2 | MKQLQPQPPPKMGDFYDPEHPTPEEEENEAKIENVQKTGFIKGPMFKGVASSRFLPKGTK TKVNLEEQGRQKVSFSFSLTKKTLQNRFLTALGNEKQSDTPNPPAVPLQVDSTPKMKMEI GDTLSTAEESSPPKSRVELGKIHFKKHLLHVTSRPLLATTTAVASPPTHAAPLPAVIAES TTVDSPPSSPPPPPPPAQATTLSSPAPVTEPVALPHTPITVLMAAPVPLPVDVAVRSLKE PPIIIVPESLEADTKQDTISNSLEEHVTQILNEQADISSKKEDSHIGKDEEIPDSSKISL SCKKTGSKKKSSQSEGIFLGSESDEDSVRTSSSQRSHDLKFSASIEKERDFKKSSAPLKS EDLGKPSRSKTDRDDKYFSYSKLERDTRYVSSRCRSERERRRSRSHSRSERGSRTNLSYS RSERSHYYDSDRRYHRSSPYRERTRYSRPYTDNRARESSDSEEEYKKTYSRRTSSHSSSY RDLRTSSYSKSDRDCKTETSYLEMERRGKYSSKLERESKRTSENEAIKRCCSPPNELGFR RGSSYSKHDSSASRYKSTLSKPIPKSDKFKNSFCCTELNEEIKQSHSFSLQTPCSKGSEL RMINKNPEREKAGSPAPSNRLNDSPTLKKLDELPIFKSEFITHDSHDSIKELDSLSKVKN DQLRSFCPIELNINGSPGAESDLATFCTSKTDAVLMTSDDSVTGSELSPLVKACMLSSNG FQNISRCKEKDLDDTCMLHKKSESPFRETEPLVSPHQDKLMSMPVMTVDYSKTVVKEPVD TRVSCCKTKDSDIYCTLNDSNPSLCNSEAENIEPSVMKISSNSFMNVHLESKPVICDSRN LTDHSKFACEEYKQSIGSTSSASVNHFDDLYQPIGSSGIASSLQSLPPGIKVDSLTLLKC GENTSPVLDAVLKSKKSSEFLKHAGKETIVEVGSDLPDSGKGFASRENRRNNGLSGKCLQ EAQEEGNSILPERRGRPEISLDERGEGGHVHTSDDSEVVFSSCDLNLTMEDSDGVTYALK CDSSGHAPEIVSTVHEDYSGSSESSNDESDSEDTDSDDSSIPRNRLQSVVVVPKNSTLPM EETSPCSSRSSQSYRHYSDHWEDERLESRRHLYEEKFESIASKACPQTDKFFLHKGTEKN PEISFTQSSRKQIDNRLPELSHPQSDGVDSTSHTDVKSDPLGHPNSEETVKAKIPSRQQE ELPIYSSDFEDVPNKSWQQTTFQNRPDSRLGKTELSFSSSCEIPHVDGLHSSEELRNLGW DFSQEKPSTTYQQPDSSYGACGGHKYQQNAEQYGGTRDYWQGNGYWDPRSGRPPGTGVVY DRTQGQVPDSLTDDREEEENWDQQDGSHFSDQSDKFLLSLQKDKGSVQAPEISSNSIKDT LAVNEKKDFSKNLEKNDIKDRGPLKKRRQEIESDSESDGELQDRKKVREVEQGETSVPP GSALVGPSCVMDDFRDPQRWKECAKQGKMPCYFDLIEENVYLTERKKNKSHRDIKRMQCE CTPLSKDERAQGEIACGEDCLNRLLMIECSSRCPNGDYCSNRRFQRKQHADVEVILTEKK GWGLRAAKDLPSNTFVLEYCGEVLDHKEFKARVKEYARNKNIHYYFMALKNDEIIDATQK GNCSRFMNHSCEPNCETQKWTVNGQLRVGFFTTKLVPSGSELTFDYQFQRYGKEAQKCFC GSANCRGYLGGENRVSIRAAGGKMKKERSRKKDS | 81 |

TABLE 9-continued

Histone methyltransferases

| Name | Sequence | SEQ ID NO: |
|---|---|---|
| SETD2 Isoform 3 | MKQLQPQPPPKMGDFYDPEHPTPEEEENEAKIENVQKTGFIKGPMFKGVASSRFLPKGTK TKVNLEEQGRQKVSFSFSLTKKTLQNRFLTALGNEKQSDTPNPPAVPLQVDSTPKMKMEI GDTLSTAEESSPPKSRVELGKIHFKKHLLHVTSRPLLATTTAVASPPTHAAPLPAVIAES TTVDSPPSSPPPPPPAQATTLSSPAPVTEPVALPHTPITVLMAAPVPLPVDVAVRSLKE PPIIIVPESLEADTKQDTISNSLEEHVTQILNEQADISSKKEDSHIGKDEEIPDSSKISL SCKKTGSKKKSSQSEGIFLGSESDEDSVRTSSSQRSHDLKFSASIEKERDFKKSSAPLKS EDLGKPSRSKTDRDDKYFSYSKLERDTRYVSSRCRSERERRRSRSHSRSERGSRTNLSYS RSERSHYYDSDRRYHRSSPYRERTRYSRPYTDNRARESSDSEEEYKKTYSRRTSSHSSSY RDLRTSSYSKSDRDCKTETSYLEMERRGKYSSKLERESKRTSENEAIKRCCSPPNELGFR RGSSYSKHDSSASRYKSTLSKPIPKSDKFKNSFCCTELNEEIKQSHSFSLQTPCSKGSEL RMINKNPEREKAGSPAPSNRLNDSPTLKKLDELPIFKSEFITHDSHDSIKELDSLSKVKN DQLRSFCPIELNINGSPGAESDLATFCTSKTDAVLMTSDDSVTGSELSPLVKACMLSSNG FQNISRCKEKDLDDTCMLHKKSESPFRETEPLVSPHQDKLMSMPVMTVDYSKTVVKEPVD TRVSCCKTKDSDIYCTLNDSNPSLCNSEAENIEPSVMKISSNSFMNVHLESKPVICDSRN LTDHSKFACEEYKQSIGSTSSASVNHFDDLYQPIGSSGIASSLQSLPPGIKVDSLTLLKC GENTSPVLDAVLKSKKSSEFLKHAGKETIVEVGSDLPDSGKGFASRENRRNNGLSGKCLQ EAQEEGNSILPERRGRPEISLDERGEGGHVHTSDDSEVVFSSCDLNLTMEDSDGVTYALK CDSSGHAPEIVSTVHEDYSGSSESSNDESDSEDTDSDDSSIPRNRLQSVVVVPKNSTLPM EETSPCSSRSSQSYRHYSDHWEDERLESRRHLYEEKFESIASKACPQTDKFFLHKGTEKN PEISFTQSSRKQIDNRLPELSHPQSDGVDSTSHTDVKSDPLGHPNSEETVKAKIPSRQQE ELPIYSSDFEDVPNKSWQQTTFQNRPDSRLGKTELSFSSSCEIPHVDGLHSSEELRNLGW DFSQEKPSTTYQQPDSSYGACGGHKYQQNAEQYGGTRDYWQGNGYWDPRSGRPPGTGVVY DRTQGQVPDSLTDDREEEENWDQQDGSHFSDQSDKFLLSLQKDKGSVQAPEISSNSIKDT LAVNEKKDFSKNLEKNDIKDRGPLKKRRQEIESDSESDGELQDRKKVRVEVEQGETSVPP GSALVGPSCVMDDFRDPQRWKECAKQGKMPCYFDLIEENVYLTERKNKSHRDIKRMQCE CTPLSKDERAQGEIACGEDCLNRLLMIECSSRCPNGDYCSNRRFQRKQHADVEVILTEKK GWGLRAAKDLPS | 82 |
| LEDGF Isoform 1 CCDS 6480.1 | MTRDFKPGDLIFAKMKGYPHWPARVDEVPDGAVKPPTNKLPIFFFGTHETAFLGPKDIFP YSENKEKYGKPNKRKGFNEGLWEIDNNPKVKFSSQQAATKQSNASSDVEVEEKETSVSKE DTDHEEKASNEDVTKAVDITTPKAARRGRKRKAEKQVETEEAGVVTTATASVNLKVSPKR GRPAATEVKIPKPRGRPKMVKQPCPSESDIITEEDKSKKKGQEEKQPKKQPKKDEEGQKE EDKPRKEPDKKEGKKEVESKRKNLAKTGVTSTSDSEEEGDDQEGEKKRKGGRNFQTAHRR NMLKGQHEKEAADRKRKQEEQMETEHQTTCNLQ | 83 |
| LEDGF Isoform 2 CCDS 6479.1 | MTRDFKPGDLIFAKMKGYPHWPARVDEVPDGAVKPPTNKLPIFFFGTHETAFLGPKDIFP YSENKEKYGKPNKRKGFNEGLWEIDNNPKVKFSSQQAATKQSNASSDVEVEEKETSVSKE DTDHEEKASNEDVTKAVDITTPKAARRGRKRKAEKQVETEEAGVVTTATASVNLKVSPKR GRPAATEVKIPKPRGRPKMVKQPCPSESDIITEEDKSKKKGQEEKQPKKQPKKDEEGQKE EDKPRKEPDKKEGKKEVESKRKNLAKTGVTSTSDSEEEGDDQEGEKKRKGGRNFQTAHRR NMLKGQHEKEAADRKRKQEEQMETEQQNKDEGKKPEVKKVEKKRETSMDSRLQRIHAEIK NSLKIDNLDVNRCIEALDELASLQVTMQQAQKHTEMITTLKKIRRFKVSQVIMEKSTMLY NKFKNMFLVGEGDSVITQVLNKSLAEQRQHEEANKTKDQGKKGPNKKLEKEQTGSKTLNG GSDAQDGNQPQHNGESNEDSKDNHEASTKKKPSSEERETEISLKDSTLDN | 84 |
| EZH2 Isoform 1 CCDS 5891.1 | MGQTGKKSEKGPVCWRKRVKSEYMRLRQLKRFRRADEVKSMFSSNRQKILERTEILNQEWKQRRIQPVHI LTSVSSLRGTRECSVTSDLDFPTQVIPLKTLNAVASVPIMYSWSPLQQNFMVEDETVLHNIPYMGDEVLD QDGTFIEELIKNYDGKVHGDRECGFINDEIFVELVNALGQYNDDDDDDGDDPEEREEKQKDLEDHRDDK ESRPPRKFPSDKIFEAISSMFPDKGTAEELKEKYKELTEQQLPGALPPECTPNIDGPNAKSVQREQSLHS FHTLFCRRCFKYDCFLHRKCNYSFHATPNTYKRKNTETALDNKPCGPQCYQHLEGAKEFAAALTAERIKT PPKRPGGRRRGRLPNNSSRPSTPTINVLESKDTSDREAGTETGGENNDKEEEEKKDETSSSSEANSRCQ TPIKMKPNIEPPENVEWSGAEASMFRVLIGTYYDNFCAIARLIGTKTCRQVYEFRVKESSIIAPAPAEDV DTPPRKKKRKHRLWAAHCRKIQLKKDGSSNHVYNYQPCDHPRQPCDSSCPCVIAQNFCEKFCQCSSECQN RFPGCRCKAQCNTKQCPCYLAVRECDPDLCLTCGAADHWDSKNVSCKNCSIQRGSKKHLLLAPSDVAGWG IFIKDPVQKNEFISEYCGEIISQDEADRRGKVYDKYMCSFLFNLNNDFVVDATRKGNKIRFANHSVNPNC YAKVMMVNGDHRIGIFAKRAIQTGEELFFDYRYSQADALKYVGIEREMEIP | 85 |
| EZH2 Isoform 2 CCDS 5892.1 | MGQTGKKSEKGPVCWRKRVKSEYMRLRQLKRFRRADEVKSMFSSNRQKILERTEILNQEWKQRRIQPVHI LTSVSSLRGTREVEDETVLHNIPYMGDEVLDQDGTFIEELIKNYDGKVHGDRECGFINDEIFVELVNALG QYNDDDDDDGDDPEEREEKQKDLEDHRDDKESRPPRKFPSDKIFEAISSMFPDKGTAEELKEKYKELTE QQLPGALPPECTPNIDGPNAKSVQREQSLHSFHTLFCRRCFKYDCFLHRKCNYSFHATPNTYKRKNTETALDNK PCGPQCYQHLEGAKEFAAALTAERIKTPPKRPGGRRRGRLPNNSSRPSTPTINVLESKDTSDREAGTETG GENNDKEEEEKKDETSSSSEANSRCQTPIKMKPNIEPPENVEWSGAEASMFRVLIGTYYDNFCAIARLIG TKTCRQVYEFRVKESSIIAPAPAEDVDTPPRKKKRKHRLWAAHCRKIQLKKDGSSNHVYNYQPCDHPRQP CDSSCPCVIAQNFCEKFCQCSSECQNRFPGCRCKAQCNTKQCPCYLAVRECDPDLCLTCGAADHWDSKNV SCKNCSIQRGSKKHLLLAPSDVAGWGIFIKDPVQKNEFISEYCGEIISQDEADRRGKVYDKYMCSFLFNL NNDFVVDATRKGNKIRFANHSVNPNCYAKVMMVNGDHRIGIFAKRAIQTGEELFFDYRYSQADALKYVGI EREMEIP | 86 |
| EZH2 Isoform 3 CCDS 56518.1 | MGQTGKKSEKGPVCWRKRVKSEYMRLRQLKRFRRADEVKSMFSSNRQKILERTEILNQEWKQRRIQPVHI LTSCSVTSDLDFPTQVIPLKTLNAVASVPIMYSWSPLQQNFMVEDETVLHNIPYMGDEVLDQDGTFIEEL IKNYDGKVHGDRECGFINDEIFVELVNALGQYNDDDDDDGDDPEEREEKQKDLEDHRDDKESRPPRKFP SDKIFEAISSMFPDKGTAEELKEKYKELTEQQLPGALPPECTPNIDGPNAKSVQREQSLHSFHTLFCRRC FKYDCFLHPFHATPNTYKRKNTETALDNKPCGPQCYQHLEGAKEFAAALTAERIKTPPKRPGGRRRGRLP | 87 |

TABLE 9-continued

Histone methyltransferases

| Name | Sequence | SEQ ID NO: |
|---|---|---|
| | NNSSRPSTPTINVLESKDTDSDREAGTETGGENNDKEEEEKKDETSSSSEANSRCQTPIKMKPNIEPPEN VEWSGAEASMFRVLIGTYYDNFCAIARLIGTKTCRQVYEFRVKESSIIAPAPAEDVDTPPRKKKRKHRLW AAHCRKIQLKKDGSSNHVYNYQPCDHPRQPCDSSCPCVIAQNFCEKFCQCSSECQNRFPGCRCKAQCNTK QCPCYLAVRECDPDLCLTCGAADHWDSKNVSCKNCSIQRGSKKHLLLAPSDVAGWGIFIKDPVQKNEFIS EYCGEIISQDEADRRGKVYDKYMCSFLFNLNNDFVVDATRKGNKIRFANHSVNPNCYAKVMMVNGDHRIG IFAKRAIQTGEELFFDYRYSQADALKYVGIEREMEIP | |
| EZH2 Isoform 4 CCDS 56517.1 | MGQTGKKSEKGPVCWRKRVKSEYMRLRQLKRFRRADEVKSMFSSNRQKILERTEILNQEWKQRRIQPVHI LTSCSVTSDLDFPTQVIPLKTLNAVASVPIMYSWSPLQQNFMVEDETVLHNIPYMGDEVLDQDGTFIEEL IKNYDGKVHGDRECGFINDEIFVELVNALGQYNDDDDDDGDDPEEREEKQKDLEDHRDDKESRPPRKFP SDKIFEAISSMFPDKGTAEELKEKYKELTEQQLPGALPPECTPNIDGPNAKSVQREQSLHSFHTLFCRRC FKYDCFLHPFHATPNTYKRKNTETALDNKPCGPQCYQHLEGAKEFAAALTAERIKTPPKRPGGRRRGRLP NNSSRPSTPTINVLESKDTDSDREAGTETGGENNDKEEEEKKDETSSSSEANSRCQTPIKMKPNIEPPEN VEWSGAEASMFRVLIGTYYDNFCAIARLIGTKTCRQVYEFRVKESSIIAPAPAEDVDTPPRKKKRKHRLW AAHCRKIQLKKGQNRFPGCRCKAQCNTKQCPCYLAVRECDPDLCLTCGAADHWDSKNVSCKNCSIQRGSK KHLLLAPSDVAGWGIFIKDPVQKNEFISEYCGEIISQDEADRRGKVYDKYMCSFLFNLNNDFVVDATRKG NKIRFANHSVNPNCYAKVMMVNGDHRIGIFAKRAIQTGEELFFDYRYSQADALKYVGIEREMEIP | 88 |
| EZH2 Isoform 5 CCDS 56516.1 | MGQTGKKSEKGPVCWRKRVKSEYMRLRQLKRFRRADEVKSMFSSNRQKILERTEILNQEWKQRRIQPVHI LTSVSSLRGTRECSVTSDLDFPTQVIPLKTLNAVASVPIMYSWSPLQQNFMVEDETVLHNIPYMGDEVLD QDGTFIEELIKNYDGKVHGDRECGFINDEIFVELVNALGQYNDDDDDDGDDPEEREEKQKDLEDHRDDK ESRPPRKFPSDKIFEAISSMFPDKGTAEELKEKYKELTEQQLPGALPPECTPNIDGPNAKSVQREQSLHS FHTLFCRRCFKYDCFLHPFHATPNTYKRKNTETALDNKPCGPQCYQHLEGAKEFAAALTAERIKTPPKRP GGRRRGRLPNNSSRPSTPTINVLESKDTDSDREAGTETGGENNDKEEEEKKDETSSSSEANSRCQTPIKM KPNIEPPENVEWSGAEASMFRVLIGTYYDNFCAIARLIGTKTCRQVYEFRVKESSIIAPAPAEDVDTPPR KKKRKHRLWAAHCRKIQLKKDGSSNHVYNYQPCDHPRQPCDSSCPCVIAQNFCEKFCQCSSECQNRFPGC RCKAQCNTKQCPCYLAVRECDPDLCLTCGAADHWDSKNVSCKNCSIQRGSKKHLLLAPSDVAGWGIFIKD PVQKNEFISEYCGEIISQDEADRRGKVYDKYMCSFLFNLNNDFVVDATRKGNKIRFANHSVNPNCYAKVM MVNGDHRIGIFAKRAIQTGEELFFDYRYSQADALKYVGIEREMEIP | 89 |

SET domain containing 2 (SETD2) has histone methyltransferase activity and methylates dimethylated lysine at amino acid position 36 on histone H3, to generate trimethylated H3K36. SETD2 increases resection by promoting the recruitment of CtIP (see, e.g., Pfister et al. (2014) Cell Rep. 7(6): 2006-18). Use of a SETD2 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous SIRT6 RMEM and/or overexpression of a heterologous SIRT6 RMEM. Candidate SETD2 RMEMs can be evaluated for c-NHEJ, alt-NHEJ (including blunt EJ, MMEJ, and SD-MMEJ), and HDR (including alt-HR, HR, and SSA) by using any of the functional assays described herein.

Lens epithelium-derived growth factor (LEDGF, also known as PC4 and SFRS 1 interacting protein 1(PSIP1)) is a downstream player of SETD2 and is recruited upon trimethylation at H3K36 (see, e.g., Pfister et al. (2014)). Use of a LEDGF RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous LEDGF RMEM and/or overexpression of a heterologous LEDGF RMEM. Candidate LEDGF RMEMs can be evaluated for c-NHEJ, alt-NHEJ (including blunt EJ, MMEJ, and SD-MMEJ), and HDR (including alt-HR, HR, and SSA) by using any of the functional assays described herein.

Enhancer of zeste homolog 2 (EZH2) is a H3K27 histone methyltransferase and a member of the Polycomb-group (PcG) family. EZH2 is recruited to the site of DNA damage and has a role in DNA damage repair (Chou et al. (2010) Proc. Nat'l. Acad. Sci. USA 107(43): 18475-80). Use of a EZH2 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous EZH2 RMEM and/or overexpression of a heterologous EZH2 RMEM. Candidate EZH2 RMEMs can be evaluated for c-NHEJ, alt-NHEJ (including blunt EJ, MMEJ, and SD-MMEJ), and HDR (including alt-HR, HR, and SSA) by using any of the functional assays described herein.

In another embodiment, the RMEM having histone methylation activity is not SETD2. In another embodiment, the RMEM does not have histone methylation activity.

Chromatin Remodeling Enzymes

In one embodiment, a RMEM comprises chromatin remodeling activity, e.g., is a chromatin remodeling enzyme. Chromatin remodeling activity includes altering the structure of chromatin, such as relaxing the chromatin, thereby allowing accessibility of DNA resection and repair machinery. In one embodiment, the chromatin remodeling activity of a RMEM comprises one or more of helicase activity, histone acetyltransferase activity, histone deacetylase activity, or histone methyltransferase activity.

Exemplary chromatin remodeling enzymes are provided in Table 10 below and are described further below.

TABLE 10

Chromatin remodeling enzymes

| Name | Sequence | SEQ ID NO: |
|---|---|---|
| INO80 CCDS 10071. | MASELGARDDGGCTELAKPLYLQYLERALRLDHFLRQTSAIFNRNISSDDSEDGLDDSNP LLPQSGDPLIQVKEEPPNSLLGETSGAGSSGMLNTYSLNGVLQSESKCDKGNLYNFSKLK KSRKWLKSILLSDESSEADSQSEDDDEEELNLSREELHNMLRLHKYKKLHQNKYSKDKEL QQYQYYSAGLLSTYDPFYEQQRHLLGPKKKKFKEEKKLKAKLKKVKKKRRRDEELSSEES PRRHHHQTKVFAKFSHDAPPPGTKKKHLSIEQLNARRRKVWLSIVKKELPKANKQKASAR NLFLTNSRKLAHQCMKEVRRAALQAQKNCKETLPRARRLTKEMLLYWKKYEKVEKEHRKR AEKEALEQRKLDEEMREAKRQQRKLNFLITQTELYAHFMSRKRDMGHDGIQEEILRKLED SSTQRQIDIGGGVVVNITQEDYDSNHFKAQALKNAENAYHIHQARTRSFDEDAKESRAAA LRAANKSGTGFGESYSLANPSIRAGEDIPQPTIFNGKLKGYQLKGMNWLANLYEQGINGI LADEMGLGKTVQSIALLAHLAERENIWGPFLIISPASTLNNWHQEFTRFVPKFKVLPYWG NPHDRKVIRRFWSQKTLYTQDAPFHVVITSYQLVVQDVKYFQRVKWQYMVLDEAQALKSS SSVRWKILLQFQCRNRLLLTGTPIQNTMAELWALLHFIMPTLFDSHEEFNEWFSKDIESH AENKSAIDENQLSRLHMILKPFMLRRIKKDVENELSDKIEILMYCQLTSRQKLLYQALKN KISIEDLLQSSMGSTQQAQNTTSSLMNLVMQFRKVCNHPELFERQETWSPFHISLKPYHI SKFIYRHGQIRVFNHSRDRWLRVLSPFAPDYIQRSLFHRKGINEESCFSFLRFIDISPAE MANLMLQGLLARWLALFLSLKASYRLHQLRSWGAPEGESHQRYLRNKDFLLGVNFPLSFP NLCSCPLLKSLVFSSHCKAVSGYSDQVVHQRRSATSSLRRCLLTELPSFLCVASPRVTAV PLDSYCNDRSAEYERRVLKEGGSLAAKQCLLNGAPELAADWLNRRSQFFPEPAGGLWSIR PQNGWSFIRIPGKESLITDSGKLYALDVLLTRLKSQGHRVLIYSQMTRMIDLLEEYMVYR KHTYMRLDGSSKISERRDMVADFQNRNDIFVFLLSTRAGGLGINLTAADTVIFYDSDWNP TVDQQAMDRAHRLGQTKQVTVYRLICKGTIEERILQRAKEKSEIQRMVISGGNFKPDTLK PKEVVSLLLDDEELEKKLRLRQEEKRQQEETNRVKERKREKYAEKKKKEDELDGKRRK EGVNLVIPFVPSADNSNLSADGDDSFISVDSAMPSPFSEISISSELHTGSIPLDESSSDM LVIVDDPASSAPQSRATNSPASITGSVSDTVNGISIQEMPAAGRGHSARSRGRPKGSGST AKGAGKGRSRKSTAGSAAAMAGAKAGAAAASAAAYAAYGYNVSKGISASSPLQTSLVRPA GLADFGPSSASSPLSSPLSKGNNVPGNPKNLHMTSSLAPDSLVRKQKGKTNPSGGR | 90 |
| SRCAP CCDS 10689.2 | MQSSPSPAHPQLPVLQTQMVSDGMTGSNPVSPASSSSPASSGAGGISPQHIAQDSSLDGP PGPPDGATVPLEGFSLSQAADLANKGPKWEKSHAEIAEQAKHEAEIETRIAELRKEGFWS LKRLPKVPEPPRPKGHWDYLCEEMQWLSADFAQERRWKRGVARKVVRMVIRHHEEQRQKE ERARREEQAKLRRIASTMAKDVRQFWSNVEKVVQFKQQSRLEEKRKKALDLHLDFIVGQT EKYSDLLSQSLNQPLTSSKAGSSPCLGSSSAASSPPPPASRLDDEDGDFQPQEDEEEDDE ETIEVEEQQGENDAEAQRREIELLRREGELPLEELLRSLPPQLLEGPSSPSQTPSSHDSD TRDGPEEGAEEEPPQVLEIKPPPSAVTQRNKQPWHPDEDDEEFTANEEEAEDEEDTIAAE EQLEGEVDHAMELSELAREGELSMEELLQQYAGAYAPGSGSSEDEDEDEVDANSSDCEPE GPVEAEEPPQEDSSSQSDSVEDRSEDEEDEHSEEEETSGSSASEESEESEESEDAQSQSQA DEEEEDDDFGVEYLLARDEEQSEADAGSGPPTPGPTTLGPKKEITDIAAAAESLQPKGYT LATTQVKTPIPLLLRGQLREYQHIGLDWLVTMYEKKLNGILADEMGLGKTIQTISLLAHL ACEKGNWGPHLIIVPTSVMLNWEMELKRWCPSFKILTYYGAQKERKLKRQGWTKPNAFHV CITSYKLVLQDHQAFRRKNWRYLILDEAQNIKNFKSQRWQSLLNFNSQRRLLLTGTPLQN SLMELWSLMHFLMPHVFQSHREFKEWFSNPLTGMIEGSQEYNEGLVKRLHKVLRPPFLLRR VKVDVEKQMPKKYEHVIRCRLSKRQRCLYDDFMAQTTTKETLATGHFMSVINILMQLRKV CNHPNLFDPRPVTSPFITPGICFSTASLVLRATDVHPLQRIDMGRFDLIGLEGRVSRYEA DTFLPRHRLSRRVLLEVATAPDPPPRPKPVKMKVNRMLQPVPKQEGRTVVVVNNPRAPLG PVPVRPPPGPELSAQPTPGPVPQVLPASLMVSASPAGPPLIPASRPPGPVLLPPLQPNSG SLPQVLPSPLGVLSGTSRPPTPTLSLKPTPPAPVRLSPAPPPGSSSLLKPLTVPPGYTFP PAAATTTSTTTATATTTAVPAPTPAPQRLILSPDMQARLPSGEVVSIGQLASLAQRPVAN AGGSKPLTFQIQGNKLTLTGAQVRQLAVGQPRPLQRNVVHLVSAGGQHHLISQPAHVALI QAVAPTPGPTPVSVLPSSTPSTTPAPTGLSLPLAANQVPPTMVNNTGVVKIVVRQAPRDG LTPVPPLAPAPRPPSSGLPAVLNPRPTLTPGRLPTPTLGTARAPMPTPTLVRPLLKLVHS PSPEVSASAPGAAPLTISSPLHVPSSLPGPASSPMPIPNSSPLASPVSSTVSVPLSSSLP ISVPTTLPAPASAPLTIPISAPLTVSASGPALLTSVTPPLAPVVPAAPGPPSLAPSGASP SASALTLGLATAPSLSSSQTPGHPLLLAPTSSHVPGLNSTVAPACSPVLVPASALASPFP SAPNPAPAQASLLAPASSASQALATPLAPMAAPQTAILAPSPAPPLAPLPVLAPSPGAAP VLASSQTPVPVMAPSSTPGTSLASASPVPAPTPVLAPSSTQTMLAPVPVSPLPSPASTQT LALAPALAPTLGGSSPSQTLSLGTGNPQGPFPTQTLSLTPASSLVPTPAQTLSLAPGPPL GPTQTLSLAPAPPLAPASPVGPAPAHTLTLAPASSSASLLAPASVQTLTLSPAPVPTLGP AAAQTLALAPASTQSPASQASSLVVSASGAAPLPVTMVSRLPVSKDEPDTLTLRSGPPSP PSTATSFGGPRPRRQPPPPPRSPFYLDSLEEKRKRQRSERLERIFQLSEAHGALAPVYGT EVLDFCTLPQPVASPIGRSPGPSHPTFWTYTEAAHRAVLFPQQRLDQLSEIIERFIFVM PPVEAPPPSLHACHPPPWLAPRQAAFQEQLASELWPRARPLHRIVCNMRTQFPDLRLQY DCGKLQTLAVLLRQLKAEGHRVLIFTQMTRMLDVLEQFLTYHGHLYLRLDGSTRVEQRQA LMERFNADKRIFCFILSTRSGGVGVNLTGADTVVFYDSDWNPTMDAQAQDRCHRIGQTRD VHIYRLISERTVEENILKKANQKRMLGDMAIEGGNFTTAYFKQQTIRELFDMPLEEPSSS SVPSAPEEEEETVASKQTHILEQALCRAEDEEDIRAATQAKAEQVAELAEFNENDGFPAG EGEEAGRPGAEDEEMSRAEQEIAALVEQLTPIERYAMKFLEASLEEVSREELKQAEEQVE AARKDLDQAKEEVFRLPQEEEEGPGAGDESSCGTGGGTHRRSKKAKAPERPGTRVSERLR GARAETQGANHTPVISAHQTRSTTTPPRCSPARERVPRPAPRPRPTPASAPAAIPALVPV PVSAPVPISAPNPITILPVHILPSPPPPSQIPPCSSPACTPPPACTPPPAHTPPPAQTCL VTPSSPLLLGPPSVPISASVTNLPLGLRPEAELCAQALASPESLELASVASSETSSLSLV PPKDLLPVAVEILPVSEKNLSLTPSAPSLTLEAGSIPNGQEQEAPDSAEGTTLTVLPEGE ELPLCVSESNGLELPPSAASDEPLQEPLEADRTSEELTEAKTPTSSPEKPQELVTAEVAA PSTSSSATSSPEGPSPARPPRRRTSADVEIRGQGTGRPGQPPGPKVLRKLPGRLVTVVEE KELVRRRQQRGAASTLVPGVSETSASPGSPSVRSMSGPESSPPIGGPCEAAPSSSLPTP | 91 |

TABLE 10-continued

Chromatin remodeling enzymes

| Name | Sequence | SEQ ID NO: |
|---|---|---|
|  | PQQPFIARRHIELGVTGGGSPENGDGALLAITPPAVKRRRGRPPKKNRSPADAGRGVDEA PSSTLKGKTNGADPVPGPETLIVADPVLEPQLIPGPQPLGPQPVHRPNPLLSPVEKRRRG RPPKARDLPIPGTISSAGDGNSESRTQPPPHPSPLTPLPPLLVCPTATVANTVTTVTIST SPPKRKRGRPPKNPPSPRPSQLPVLDRDSTSVLESCGLGRRRQPQGQGESEGSSSDEDGS RPLTRLARLRLEAEGMRGRKSGGSMVVAVIQDDLDLADSGPGGLELTPPVVSLTPKLRST RLRPGSLVPPLETEKLPRKRAGAPVGGSPGLAKRGRLQPPSPLGPEGSVEESEAEASGEE EEGDGTPRRRPGPRRLVGTTNQGDQRILRSSAPPSLAGPAVSHRGRKAKT |  |
| ZNHIT1/p18 CCDS 5716.1 | MVEKKTSVRSQDPGQRRVLDRAARQRRINRQLEALENDNFQDDPHAGLPQLGKRLPQFDD DADTGKKKKKTRGDHFKLRFRKNFQALLEEQNLSVAEGPNYLTACAGPPSRPQRPFCAVC GFPSPYTCVSCGARYCTVRCLGTHQETRCLKWTV | 92 |

IONO80 complex (INO80) has chromatin remodeling activity in relaxing the chromatin, eviction of nucleosomes. The INO80 complex subunit is the catalytic subunit that has chromatin relaxing activity, and has helicase activity (see, e.g., Van Attikum et al. (2004) CELL 119(6): 777-88; Conaway and Conaway (2009) TRENDS BIOCHEM. SCI. 34(2): 71-7). Use of a INO80 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous INO80 RMEM and/or overexpression of a heterologous INO80 RMEM. Candidate INO80 RMEMs can be evaluated for c-NHEJ, alt-NHEJ (including blunt EJ, MMEJ, and SD-MMEJ), and HDR (including alt-HR, HR, and SSA) by using any of the functional assays described herein.

Snf2-related CREBBP activator complex (SRCAP or SWR1) has chromatin remodeling activity in relaxing the chromatin, and plays a role in transcriptional regulation and DNA repair and replication. The complex is recruited at double strand breaks and promotes resection and HDR. The complex interacts with CtIP. Snf2-related CREBBP activator protein is the catalytic subunit of the SRCAP complex and can have helicase activity (see, e.g., Dong et al. (2014) CURR. BIOL. 24(18): 2097-110; Gerhold and Gasser (2014) TRENDS CELL BIOL. 24(11): 619-31). Use of a SRCAP RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with a Cas9 molecule in the absence of increased expression of an endogenous SRCAP RMEM and/or overexpression of a heterologous SRCAP RMEM. Candidate SRCAP RMEMs can be evaluated for c-NHEJ, alt-NHEJ (including blunt EJ, MMEJ, and SD-MMEJ), and HDR (including alt-HR, HR, and SSA) by using any of the functional assays described herein.

Zinc finger, HIT type containing 1 (ZNHIT1/p18) plays a role in chromatin remodeling and relaxes chromatin (see, e.g., Dong et al. (2014); Gerhold and Gasser (2014)). Use of a ZNHIT1 RMEM in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous ZNHIT1 RMEM and/or overexpression of a heterologous ZNHIT1 RMEM. Candidate ZNHIT1 RMEMs can be evaluated for c-NHEJ, alt-NHEJ (including blunt EJ, MMEJ, and SD-MMEJ), and HDR (including alt-HR, HR, and SSA) by using any of the functional assays described herein.

In another embodiment, the chromatin remodeling protein is not INO80. In another embodiment, the RMEM is not a chromatin remodeling protein.

Histone Chaperones

In one embodiment, a RMEM comprises chaperone activity for a chromatin-related protein, e.g., is a histone chaperone. Histone chaperone activity includes altering the structure of chromatin or facilitating the assembly of chromatin-associated complexes, and modulates the accessibility of DNA resection and repair machinery.

Exemplary histone chaperones are provided in Table 11 below and are described further below.

TABLE 11

Histone Chaperone

| Name | Sequence | SEQ ID NO: |
|---|---|---|
| Nap1 CCDS 9013.1 | MADIDNKEQSELDQDLDDVEEVEEEETGEETKLKARQLTVQMMQNPQILAALQERLDGLV ETPTGYIESLPRVVKRRVNALKNLQVKCAQIEAKFYEEVHDLERKYAVLYQPLFDKRFEI INAIYEPTEEECEWKPDEEDEISEELKEKAKIEDEKKDEEKEDPKGIPEFWLTVFKNVDL LSDMVQEHDEPILKHLKDIKVKFSDAGQPMSFVLEFHFEPNEYFTNEVLTKTYRMRSEPD DSDPFSFDGPEIMGCTGCQIDWKKGKNVTLKTIKKKQKHKGRGTVRTVTKTVSNDSFFNF FAPPEVPESGDLDDDAEAILAADFEIGHFLRERIIPRSVLYFTGEAIEDDDDDYDEEGEE ADEEGEEEGDEENDPDYDPKKDQNPAECKQQ | 93 |

Nucleosome assembly protein 1 (Nap1) has histone chaperone activity and promotes nucleosome assembly. Nap1 is recruited at sites of DNA damage and plays a role in HDR. Specifically, Nap1 recruits RAD54 and RAD 51 (Machida et al. (2014) SCI. REP. 4: 4863). Use of a Nap1 RMEM in combination with an RNA-guided nuclease, e.g., Cas9 molecule, in the methods as described herein can increase HDR as compared to the level of repair seen with an RNA-guided nuclease, e.g., Cas9 molecule, in the absence of increased expression of an endogenous Nap1 RMEM and/or overexpression of a heterologous Nap1 RMEM. Candidate Nap1 RMEMs can be evaluated for HDR by using a functional assays described herein.

In another embodiment, the RMEM is not a histone chaperone.

Nucleic Acid Binding Proteins

In some embodiments, the RMEM is a nucleic acid binding protein. In one embodiment, the nucleic acid protein is HNRNPA1, UP1 Filament of HNRNPA1, NABP2 (SSB1) or NABP1 (SSB2). Exemplary nucleic acid binding proteins are provided in Table 12 and are further described below.

Exemplary RNA/DNA hybrid processing factors are provided and described further below.

Provided below is an amino acid sequence for RNAse H1 CCDS 1647.1.

(SEQ ID NO: 98)
MSWLLFLAHRVALAALPCRRGSRGFGMFYAVRRGRKTGVFLTWNECRAQV

DRFPAARFKKFATEDEAWAFVRKSASPEVSEGHENQHGQESEAKASKRLR

EPLDGDGHESAEPYAKHMKPSVEPAPPVSRDTFSYMGDFVVVYTDGCCSS

NGRRRPRAGIGVYWGPGHPLNVGIRLPGRQTNQRAEIHAACKAIEQAKTQ

NINKLVLYTDSMFTINGITNWVQGWKKNGWKTSAGKEVINKEDFVALERL

TQGMDIQWMHVPGHSGFIGNEEADRLAREGAKQSED

Provided below is an amino acid sequence for RNAse H2 subunit A CCDS 12282.1.

TABLE 12

Nucleic Acid Binding Proteins

| Name | Sequence | SEQ ID NO: |
|---|---|---|
| HNRNPA1 | >gi\|4504445\|ref\|NP_002127.1\|heterogeneous nuclear ribonucleoprotein A1 isoform a [Homo sapiens]<br>MSKSESPKEPEQLRKLFIGGLSFETTDESLRSHFEQWGTLTDCVVMRDPNTKRSRGFGFVTYA<br>TVEEVDAAMNARPHKVDGRVVEPKRAVSREDSQRPGAHLTVKKIFVGGIKEDTEEHHLRDYFE<br>QYGKIEVIEIMTDRGSGKKRGFAFVTFDDHDSVDKIVIQKYHTVNGHNCEVRKALSKQEMASA<br>SSSQRGRSGSGNFGGGRGGGFGGNDNFGRGGNFSGRGGFGGSRGGGYGGSGDGYNGFGNDGS<br>NFGGGGSYNDFGNYNNQSSNFGPMKGGNFGGRSSGPYGGGGQYFAKPRNQGGYGGSSSSSSYG<br>SGRRF<br>>gi\|14043070\|ref\|NP_112420.1\|heterogeneous nuclear ribonucleoprotein A1 isoform b [Homo sapiens]<br>MSKSESPKEPEQLRKLFIGGLSFETTDESLRSHFEQWGTLTDCVVMRDPNTKRSRGFGFVTYA<br>TVEEVDAAMNARPHKVDGRVVEPKRAVSREDSQRPGAHLTVKKIFVGGIKEDTEEHHLRDYFE<br>QYGKIEVIEIMTDRGSGKKRGFAFVTFDDHDSVDKIVIQKYHTVNGHNCEVRKALSKQEMASA<br>SSSQRGRSGSGNFGGGRGGGFGGNDNFGRGGNFSGRGGFGGSRGGGYGGSGDGYNGFGNDGG<br>YGGGGPGYSGGSRGYGSGGQGYGNQGSGYGGSGSYDSYNNGGGGGFGGGSGSNFGGGGSYNDF<br>GNYNNQSSNFGPMKGGNFGGRSSGPYGGGGQYFAKPRNQGGYGGSSSSSSYGSGRRF | 94 |
| UP1 Filament of HNRNPA1 | KSESPKEPEQLRKLFIGGLSFETTDESLRSHFEQWGTLTDCVVMRDPNTKRSRGFGFVTYATV<br>EEVDAAMNARPHKVDGRVVEPKRAVSREDSQRPGAHLTVKKIFVGGIKEDTEEHHLRDYFEQY<br>GKIEVIEIMTDRGSGKKRGFAFVTFDDHDSVDKIVIQKYHTVNGHNCEVRKALSKQ | 95 |
| NABP2 (SSB1) | MFRRPVLQVLRQFVRHESETTTSLVLERSLNRVHLLGRVGQDPVLRQVEGKNPVTIFSLATNE<br>MWRSGDSEVYQLGDVSQKTTWHRISVFRPGLRDVAYQYVKKGSRIYLEGKIDYGEYMDKNNVR<br>RQATTIIADNIIFLSDQTKEKE<br>MTTETFVKDIKPGLKNLNLIFIVLETGRVTKTKDGHEVRTCKVADKTGSINISVWDDVGNLIQ<br>PGDIIRLTKGYASVFKGCLTLYTGRGGDLQKIGEFCMVYSEVPNFSEPNPEYSTQQAPNKAVQ<br>NDSNPSASQPTTGPSAASPASENQNGNGLSAPPGPGGGPHPPHTPSHPPSTRITRSQPNHTPA<br>GPPGPSSNPVSNGKETRRSSKR | 96 |
| NABP1 (SSB2) | MNRVNDPLIFIRDIKPGLKNLNVVFIVLEIGRVTKTKDGHEVRSCKVADKTGSITISVWDEIG<br>GLIQPGDIIRLTRGYASMWKGCLTLYTGRGGELQKIGEFCMVYSEVPNFSEPNPDYRGQQNKG<br>AQSEQKNNSMNSNMGTGTFGPVGNGVHTGPESREHQFSHAGRSNGRGLINPQLQGTASNQTVM<br>TTISNGRDPRRAFKR<br>MWKGCLTLYTGRGGELQKIGEFCMVYSEVPNFSEPNPDYRGQQNKGAQSEQKNNSMNSNMGTG<br>TFGPVGNGVHTGPESREHQFSHAGRSNGRGLINPQLQGTASNQTVMTTISNGRDPRRAFKR | 97 |

RNA/DNA Hybrid Processing Factors

In one embodiment, a RMEM comprises RNA/DNA hybrid Processing activity, e.g., is an RNA/DNA hybrid processing factors. RNA/DNA processing activity includes processing of DNA/RNA interactions as they occur during gRNA/DNA interactions. The activity of RNA/DNA processing factors might facilitate or inhibit a repair pathway, activity or outcome.

(SEQ ID NO: 99)
MDLSELERDNTGRCRLSSPVPAVCRKEPCVLGVDEAGRGPVLGPMVYAIC

YCPLPRLADLEALKVADSKTLLESERERLFAKMEDTDFVGWALDVLSPNL

ISTSMLGRVKYNLNSLSHDTATGLIQYALDQGVNVTQVFVDTVGMPETYQ

ARLQQSFPGIEVTVKAKADALYPVVSAASICAKVARDQAVKKWQFVEKLQ

DLDTDYGSGYPNDPKTKAWLKEHVEPVFGFPQFVRFSWRTAQTILEKEAE

DVIWEDSASENQEGLRKITSYFLNEGSQARPRSSHRYFLERGLESATSL

Provided below is an amino acid sequence for RNAse H2 subunit B CCDS 45047.1 (Isoform 1).

(SEQ ID NO: 100)
MAAGVDCGDGVGARQHVFLVSEYLKDASKKMKNGLMFVKLVNPCSGEGAI

YLFNMCLQQLFEVKVFKEKHHSWFINQSVQSGGLLHFATPVDPLFLLLHY

LIKADKEGKFQPLDQVVVDNVFPNCILLLKLPGLEKLLHHVTEEKGNPEI

DNKKYYKYSKEKTLKWLEKKVNQTVAALKTNNVNVSSRVQSTAFFSGDQA

STDKEEDYIRYAHGLISDYIPKELSDDLSKYLKLPEPSASLPNPPSKMAA

QRQKRGK

Provided below is an amino acid sequence for RNAse H2 subunit B. CCDS9425.1 (Isoform 2)

(SEQ ID NO: 101)
MAAGVDCGDGVGARQHVFLVSEYLKDASKKMKNGLMFVKLVNPCSGEGAI

YLFNMCLQQLFEVKVFKEKHHSWFINQSVQSGGLLHFATPVDPLFLLLHY

LIKADKEGKFQPLDQVVVDNVFPNCILLLKLPGLEKLLHHVTEEKGNPEI

DNKKYYKYSKEKTLKWLEKKVNQTVAALKTNNVNVSSRVQSTAFFSGDQA

STDKEEDYIRYAHGLISDYIPKELSDDLSKYLKLPEPSASLPNPPSKKIK

LSDEPVEAKEDYTKFNTKDLKTEKKNSKMTAAQKALAKVDKSGMKSIDTF

FGVKNKKIGKV

Provided below is an amino acid sequence for RNAse H2 subunit C. CCDS8111.1

(SEQ ID NO: 102)
MESGDEAAIERHRVHLRSATLRDAVPATLHLLPCEVAVDGPAPVGRFFTP

AIRQGPEGLEVSFRGRCLRGEEVAVPPGLVGYVMVTEEKKVSMGKPDPLR

DSGTDDQEEEPLERDFDRFIGATANFSRFTLWGLETIPGPDAKVRGALTW

PSLAAAIHAQVPED

Provided below is an amino acid sequence for Senataxin.

(SEQ ID NO: 103)
MSTCCWCTPGGASTIDFLKRYASNTPSGEFQTADEDLCYCLECVAEYHKA

RDELPFLHEVLWELETLRLINHFEKSMKAEIGDDDELYIVDNNGEMPLFD

ITGQDFENKLRVPLLEILKYPYLLLHERVNELCVEALCRMEQANCSFQVF

DKHPGIYLFLVHPNEMVRRWAILTARNLGKVDRDDYYDLQEVLLCLFKVI

ELGLLESPDIYTSSVLEKGKLILLPSHMYDTTNYKSYWLGICMLLTILEE

QAMDSLLLGSDKQNDFMQSILHTMEREADDDSVDPFWPALHCFMVILDRL

GSKVWGQLMDPIVAFQTIINNASYNREIRHIRNSSVRTKLEPESYLDDMV

TCSQIVYNYNPEKTKKDSGWRTAICPDYCPNMYEEMETLASVLQSDIGQD

MRVHNSTFLWFIPFVQSLMDLKDLGVAYIAQVVNHLYSEVKEVLNQTDAV

CDKVTEFFLLILVSVIELHRNKKCLHLLWVSSQQWVEAVVKCAKLPTTAF

TRSSEKSSGNCSKGTAMISSLSLHSMPSNSVQLAYVQLIRSLLKEGYQLG

QQSLCKRFWDKLNLFLRGNLSLGWQLTSQETHELQSCLKQIIRNIKFKAP

PCNTFVDLTSACKISPASYNKEESEQMGKTSRKDMHCLEASSPTFSKEPM

KVQDSVLIKADNTIEGDNNEQNYIKDVKLEDHLLAGSCLKQSSKNIFTER

AEDQIKISTRKQKSVKEISSYTPKDCTSRNGPERGCDRGIIVSTRLLTDS

STDALEKVSTSNEDFSLKDDALAKTSKRKTKVQKDEICAKLSHVIKKQHR

KSTLVDNTINLDENLTVSNIESFYSRKDTGVQKGDGFIHNLSLDPSGVLD

DKNGEQKSQNNVLPKEKQLKNEELVIFSFHENNCKIQEFHVDGKELIPFT

EMTNASEKKSSPFKDLMTVPESRDEEMSNSTSVIYSNLTREQAPDISPKS

DTLTDSQIDRDLHKLSLLAQASVITFPSDSPQNSSQLQRKVKEDKRCFTA

NQNNVGDTSRGQVIIISDSDDDDDERILSLEKLTKQDKICLEREHPEQHV

STVNSKEEKNPVKEEKTETLFQFEESDSQCFEFESSSEVFSVWQDHPDDN

NSVQDGEKKCLAPIANTTNGQGCTDYVSEVVKKGAEGIEEHTRPRSISVE

EFCEIEVKKPKRKRSEKPMAEDPVRPSSSVRNEGQSDTNKRDLVGNDFKS

IDRRTSTPNSRIQRATTVSQKKSSKLCTCTEPIRKVPVSKTPKKTHSDAK

KGQNRSSNYLSCRTTPAIVPPKKFRQCPEPTSTAEKLGLKKGPRKAYELS

QRSLDYVAQLRDHGKTVGVVDTRKKTKLISPQNLSVRNNKKLLTSQELQM

QRQIRPKSQKNRRRLSDCESTDVKRAGSHTAQNSDIFVPESDRSDYNCTG

GTEVLANSNRKQLIKCMPSEPETIKAKHGSPATDDACPLNQCDSVVLNGT

VPTNEVIVSTSEDPLGGGDPTARHIEMAALKEGEPDSSSDAEEDNLFLTQ

NDPEDMDLCSQMENDNYKLIELIHGKDTVEVEEDSVSRPQLESLSGTKCK

YKDCLETTKNQGEYCPKHSEVKAADEDVFRKPGLPPPASKPLRPTTKIFS

SKSTSRIAGLSKSLETSSALSPSLKNKSKGIQSILKVPQPVPLIAQKPVG

EMKNSCNVLHPQSPNNSNRQGCKVPFGESKYFPSSSPVNILLSSQSVSDT

FVKEVLKWKYEMFLNFGQCGPPASLCQSISRPVPVRFHNYGDYFNVFFPL

MVLNTFETVAQEWLNSPNRENFYQLQVRKFPADYIKYWEFAVYLEECELA

KQLYPKENDLVFLAPERINEEKKDTERNDIQDLHEYHSGYVHKFRRTSVM

RNGKTECYLSIQTQENFPANLNELVNCIVISSLVTTQRKLKAMSLLGSRN

QLARAVLNPNPMDFCTKDLLTTTSERIIAYLRDFNEDQKKAIETAYAMVK

HSPSVAKICLIHGPPGTGKSKTIVGLLYRLLTENQRKGHSDENSNAKIKQ

NRVLVCAPSNAAVDELMKKIILEFKEKCKDKKNPLGNCGDINLVRLGPEK

SINSEVLKFSLDSQVNHRMKKELPSHVQAMHKRKEFLDYQLDELSRQRAL

CRGGREIQRQELDENISKVSKERQELASKIKEVGRPQKTQSIIILESHI

ICCTLSTSGGLLLESAFRGQGGVPFSCVIVDEAGQSCEIETLTPLIHRCN

KLILVGDPKQLPPTVISMKAQEYGYDQSMMARFCRLLEENVEHNMISRLP

ILQLTVQYRMHPDICLFPSNYVYNRNLKTNRQTEAIRCSSDWPFQPYLVF

DVGDGSERRDNDSYINVQEIKLVMEIIKLIKDKRKDVSFRNIGIITHYKA

QKTMIQKDLDKEFDRKGPAEVDTVDAFQGRQKDCVIVTCVRANSIQGSIG

FLASLQRLNVTITRAKYSLFILGHLRTLMENQHWNQLIQDAQKRGAIIKT

CDKNYRHDAVKILKLKPVLQRSLTHPPTIAPEGSRPQGGLPSSKLDSGFA

```
-continued
KTSVAASLYHTPSDSKEITLTVTSKDPERPPVHDQLQDPRLLKRMGIEVK

GGIFLWDPQPSSPQHPGATPPTGEPGFPVVHQDLSHIQQPAAVVAALSSH

KPPVRGEPPAASPEASTCQSKCDDPEEELCHRREARAFSEGEQEKCGSET

HHTRRNSRWDKRTLEQEDSSSKKRKLL
```

RNase H Enzyme Complex.

Rnase H1 enzyme complex is formed by RNAse H1 and the heterotrimeric complex RNase H2 (consisting pf RNAse H2 subunit A, RNAse H2 subunit B, and RNAse H2 subunit C). The RNAse H enzyme complex cleaves and degrades the RNA in the RNA-DNA hybrid leading to the resolution of the DNA-RNA hybrid. RnaseH enzyme complex activity is critical for the maintenance of genome integrity, as knockdown of components of the complex result in genome instability and an increase in DNA-RNA hybrid formation (Hamperl et al DNA Repair 2014). Overexpression of RNAseH complex components has been shown to suppress the aberrant phenotypes associated with DNA-RNA hybrids (Hamperl et al DNA Repair 2014). Use of any component of the RNase H enzyme complex in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous RNAseH complex RMEM and/or overexpression of a heterologous RNAseH complex RMEM. Candidate RNAseH complex RMEMs can be evaluated for c-NHEJ, alt-NHEJ (including blunt EJ, MMEJ, and SD-MMEJ), and HDR (including alt-HR, HR, and SSA) by using any of the functional assays described herein, e.g., in Section VIII.

Senataxin.

Senataxin is a helicase that contributes to the unwinding of DNA-RNA hybrid structures, which promotes the subsequent cleavage and degradation of the DNA-RNA hybrid structures. Senataxin co-localizes to sites of collision between transcription and replication, and it also co-localizes to sites of replication blockage (Hamperl et al DNA Repair 2014). Use of any component of the RNase H enzyme complex in combination with an RNA-guided nuclease, e.g., Cas9 molecule, in the methods as described herein can increase or decrease one or more of the following: c-NHEJ, alt-NHEJ (including blunt EJ, MMEJ, and SD-MMEJ), and HDR (including alt-HR, HR, and SSA) as compared to the level of resection or repair seen with an RNA-guided nuclease, e.g., Cas9 molecule, in the absence of increased expression of an endogenous Senataxin RMEM and/or overexpression of a heterologous Senataxin RMEM. Candidate Senataxin RMEMs can be evaluated for c-NHEJ, alt-NHEJ (including blunt EJ, MMEJ, and SD-MMEJ), and HDR (including alt-HR, HR, and SSA) by using any of the functional assays described herein, e.g., in Section VIII.

VI. Cas9 Linkers

In an aspect, a linker is utilized to connect two Cas9 molecule domains. In one embodiment, a linker is a short peptide. Disclosed herein are linkers that can be utilized in a Cas9 molecule, e.g., disposed between the amino acids flanking a deletion, e.g., a REC2 deletion, and a Cas9 core domain and a heterologous PI domain. Preferably, the linker allows proper folding and function of the domains that are joined.

Linkers for use in generating recombinant proteins, e.g., multi-domain proteins, are known in the art (Chen et al. (2013) ADV DRUG DELIVERY REV. 65: 1357-69). Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9.

A flexible linker can be utilized in the Cas9 molecules described herein. Flexible linkers allow a certain degree of movement and/or interaction within and between the joined domains or regions of the protein. Generally, flexible linkers are composed of small, non-polar (e.g., Gly) or polar (e.g., Ser or Thr) amino acids. The small size of these amino acids provides flexibility and allows mobility of the connected domains or regions. Furthermore, the incorporation of Ser or Thr can help maintain the stability of the linker in aqueous solutions by hydrogen bonding with the water molecules, thereby reducing unfavorable interactions between the linker and the other protein moieties. Commonly used flexible linkers are comprised of sequences that primarily consist of Gly and Ser residues. Often, these flexible linkers consist of repeating units of a combination of Gly and Ser residues, e.g., (GGS)x, where the number of repeating units, e.g., x, can be optimized to achieve the appropriate separation of other domains or regions of the protein.

In some cases, a rigid linker may be preferred if there is significant distance between the joined domains or regions, or to maintain a fixed distance between the joined domains or regions of a protein and independent functions of the domains/regions. Rigid linkers often have defined secondary structure, e.g., alpha helix, or other stabilizing interactions, e.g., salt bridges and disulfide bonds. Rigid linkers commonly contain multiple Pro residues, or repeating combinations of Glu-Pro or Lys-Pro because Pro imposes a strong conformation constraint due to its structure.

The linker can comprises an amino acid residue, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acid residues. Typically, the linker will comprises less than 10, 20 or 30 amino acid residues. Typically, the linker is less than 50, 40, 30, 20, 10, or 5% of the length of the deleted sequence. Suitable linkers include: [Gly-Ser]$_x$, wherein x is 1, 2, 3, 4, 5, 6, 7, 8, 9, or 10 (SEQ ID NO: 104); [Gly-Gly-Ser]$_x$, wherein x is 1, 2, 3, 4, 5, 6, 7, 8, 9, or 10; [Gly-Gly-Ser]; [Gly-Ser-Gly-Ser]$_x$, wherein x is 1, 2, 3, 4, or 5 (SEQ ID NO: 105); [Gly-Ser-Gly-Ser] (SEQ ID NO: 106); (GSAGSAAGSGEF)$_x$, wherein x is 1, 2, 3 or 4 (SEQ ID NO: 107); (SIVAQLSRPDPA) x, wherein x is 1, 2, 3 or 4 (SEQ ID NO: 108); or an XTEN sequence, e.g., the XTEN sequence of SEQ ID NO: 109, or a sequence that differs therefrom by no more than 1, 2, 3, 4, 5, 6, 7, 8, 9 or 10 amino acid residues.

The length of the linkers can be easily adjusted by changing the copy number of repeating units of the linkers described above to achieve an optimal distance between the domains or regions that are to be joined. In one embodiment, the different linkers can be joined together to achieve optimal distance, flexibility, or rigidity between the joined domains or regions of Cas9.

In one embodiment, the linker comprises glycine and serine residues. In one embodiment the linker consists of glycine and serine residues. For instance, the linker may comprise one of more modules such as GGS, GSGS (SEQ ID NO: 110), GGGS (SEQ ID NO: 111), GGGGS (SEQ ID NO: 112) or GGSG (SEQ ID NO: 113). In one embodiment, the linker comprises a plurality of modules comprising glycine and serine, e.g., at least 2, 3, 4, 5, 10, or 15 of these modules, and/or at most 3, 4, 5, 10, 15, or 20 of these modules, or any combination of these endpoints. In one embodiment, each module in the linker has the same sequence, and In one embodiment, at least two modules in a linker have different sequences from each other.

In one embodiment, the linker is an XTEN linker or a variation of an XTEN linker such as SGSETPGTSESA (SEQ ID NO: 114), SGSETPGTSESATPES (SEQ ID NO: 115), or SGSETPGTSESATPEGGSGGS (SEQ ID NO: 116). Additional information on the XTEN linker is found in Schellenberger et al. (2009) NATURE BIOTECHNOLOGY 27(12): 1186-1190.

Exemplary linker modules are provided in Table 13.

TABLE 13

Exemplary peptide linkers

| Linker (amino acid sequence) | SEQ ID NO: |
|---|---|
| GGS | 117 |
| GSGS | 118 |
| GGGS | 119 |
| GGGGS | 120 |
| GGSG | 121 |
| SGSETPGTSESA | 122 |
| SGSETPGTSESATPES | 123 |
| SGSETPGTSESATPEGGSGGS | 124 |

Additional exemplary linker modules are provided in Table 14.

TABLE 14

Exemplary linkers

| Name | Description | Length (nt) |
|---|---|---|
| BBa_J176131 | PLrigid | 60 |
| BBa_J18920 | 2 aa GS linker | 6 |
| BBa_J18921 | 6 aa [GS]x linker | 18 |
| BBa_J18922 | 10 aa [GS]x linker | 30 |
| BBa_K105012 | 10 aa flexible protein domain linker | 30 |
| BBa_K133132 | 8 aa protein domain linker | 24 |
| BBa_K1486003 | flexible linker 2x (GGGS) | 24 |
| BBa_K1486004 | flexible linker 2x (GGGGS) | 30 |
| BBa_K1486037 | linker | 39 |
| BBa_K157009 | Split fluorophore linker; Freiburg standard | 51 |
| BBa_K157013 | 15 aa flexible glycine-serine protein domain linker; Freiburg standard | 45 |
| BBa_K243004 | Short Linker (Gly-Gly-Ser-Gly) | 12 |
| BBa_K243005 | Middle Linker (Gly-Gly-Ser-Gly)x2 | 24 |
| BBa_K243006 | Long Linker (Gly-Gly-Ser-Gly)x3 | 36 |
| BBa_K243029 | GSAT Linker | 108 |
| BBa_K243030 | SEG | 108 |
| BBa_K404300 | SEG-Linker | 108 |
| BBa_K404301 | GSAT-Linker | 108 |
| BBa_K404303 | Z-EGFR-1907_Short-Linker | 192 |
| BBa_K404304 | Z-EGFR-1907_Middle-Linker | 204 |
| BBa_K404305 | Z-EGFR-1907_Long-Linker | 216 |
| BBa_K404306 | Z-EGFR-1907_SEG-Linker | 288 |
| BBa_K416001 | (Gly$_4$Ser)$_3$ Flexible Peptide Linker | 45 |
| BBa_K648005 | Short Fusion Protein Linker: GGSG with standard 25 prefix/suffix | 12 |

TABLE 14-continued

Exemplary linkers

| Name | Description | Length (nt) |
|---|---|---|
| BBa_K648006 | Long 10AA Fusion Protein Linker with Standard 25 Prefix/Suffix | 30 |
| BBa_K648007 | Medium 6AA Fusion Protein Linker: GGSGGS with Standard 25 Prefix/Suffix | 18 |

Linkers can comprise a direct bond or an atom such as, e.g., an oxygen (O) or sulfur (S), a unit such as —NR— wherein R is hydrogen or alkyl, —C(O)—, —C(O)O—, —C(O)NH—, SO, SO$_2$, —SO$_2$NH— or a chain of atoms, such as substituted or unsubstituted alkyl, substituted or unsubstituted alkenyl, substituted or unsubstituted alkynyl, arylalkyl, heteroarylalkyl. In one embodiment, one or more methylenes in the chain of atoms can be replaced with one or more of O, S, S(O), SO$_2$, —SO$_2$NH—, —NR—, —C(O)—, —C(O)O—, —C(O)NH—, a cleavable linking group, substituted or unsubstituted aryl, substituted or unsubstituted heteroaryl, and substituted or unsubstituted heterocyclic.

VII. Nucleic Acids

In some aspects, disclosed herein is a nucleic acid, e.g., an isolated or non-naturally occurring nucleic acid, e.g., DNA, that encodes a RNA-guided nuclease, e.g., Cas9, molecule and/or a RMEM. Also provided herein are vector molecules encoding the Cas9 molecule, or the RMEM, or both, e.g., expression vectors or viral vectors.

In one embodiment, the nucleic acid molecule encodes a RNA-guided nuclease, e.g., Cas9, molecule, a gRNA molecule, and/or a RMEM. In one embodiment, the nucleic acid molecule comprises a sequence encoding a RNA-guided nuclease, e.g., Cas9, molecule, a sequence encoding a gRNA molecule, and a sequence encoding a RMEM, where each of the sequences is under the control of its own promoter. In this embodiment, the promoter controlling RNA-guided nuclease molecule expression, the promoter controlling gRNA expression, and the promoter controlling RMEM expression can be the same promoter or can be different promoters. In another embodiment, the nucleic acid molecule encoding a RNA-guided nuclease molecule, the nucleic acid molecule encoding the gRNA molecule, and the nucleic acid molecule encoding a RMEM are different nucleic acid molecules.

Optionally, the nucleic acid molecule encoding a RNA-guided nuclease molecule, the gRNA molecule, and/or a RMEM described herein further comprises one or both of a gRNA or a template nucleic acid molecule. In one embodiment, the nucleic acid molecule encoding a RNA-guided nuclease molecule and/or a RMEM described herein further comprises a gRNA molecule described herein. In one embodiment, the nucleic acid molecule comprises more than one gRNA molecule, e.g., a second gRNA molecule, a third gRNA molecule, or a fourth gRNA molecule. Promoters operably linked to the RNA-guided nuclease molecule and/or the RMEM and any gRNA molecule can be the same or can be different. In one embodiment, the nucleic acid molecule encoding a RNA-guided nuclease molecule and/or a RMEM described herein further comprises a template nucleic acid.

The techniques used to isolate or clone a nucleic acid sequence encoding a polypeptide, e.g., a RNA-guided nuclease molecule or a RMEM, are known in the art and include isolation from genomic DNA, preparation from cDNA, isolation from a genomic or cDNA library, DNA synthesis or a combination thereof. The cloning of the nucleic acid sequences of the present disclosure from such genomic DNA can be effected, e.g., by using the well-known polymerase chain reaction (PCR) See, e.g., Innis et al. (1990) PCR: A GUIDE TO METHODS AND APPLICATION, Academic Press, New York. Other amplification procedures such as ligase chain reaction (LCR), ligated activated transcription (LAT) and nucleotide sequence-based amplification (NASBA) may be used.

The nucleic acid sequence may be obtained by standard cloning procedures used in genetic engineering to relocate the nucleic acid sequence from its natural location to a different site where it will be reproduced. The cloning procedures may involve excision and isolation of a desired fragment comprising the nucleic acid sequence encoding a RNA-guided nuclease, or a RMEM, or fragments or domains thereof, insertion of the fragment into a vector molecule, and incorporation of the vector molecule into a host cell where multiple copies or clones of the nucleic acid will be replicated. In one embodiment, the nucleic acid sequence encoding a RNA-guided nuclease molecule and/or a RMEM is not relocated into a vector, and rather, is delivered using vector-free methods, to a desired host or target cell. The nucleic acid sequence may be of genomic, cDNA, RNA, semisynthetic, synthetic origin, or any combinations thereof.

In addition or alternatively, the nucleic acid sequence can be codon optimized, e.g., at least one non-common codon or less-common codon has been replaced by a common codon. For example, the nucleic acid can direct the synthesis of an optimized messenger mRNA, e.g., optimized for expression in a mammalian expression system, e.g., described herein. In one embodiment, at least about 10, 20, 30, 40, 50, 60, 70, 80, 81, 82, 83, 84, 85, 86, 87, 88, 89, 90, 91, 92, 93, 94, 95, 96, 97, 98, or 99% of the codons in the nucleic acid sequence are optimized. In one embodiment, the term "optimized codon" refers to the following codons: Ala (gcc); Arg (aga); Asn (aac); Asp (gac); Cys (ugc); Gln (cag); Gly (ggc); His (cac); Ile (auc); Leu (cug); Lys (aag); Pro (ccc); Phe (uuc); Ser (agc); Thr (acc); Tyr (uac); Glu (gag); and Val (gug), and all codons other than optimized codons are non-common codons or less-common codons.

In an aspect, a nucleic acid molecule described herein is disposed in a vector. The vector molecule is an expression vector comprising a suitable control sequence operably linked to, and capable of effecting the expression, e.g., in an in vitro transcription/translation system or in a host cell when the vector is introduced in the host cell, of the nucleic acid molecules described herein encoding a RNA-guided nuclease molecule and/or a RMEM. For example, the vector comprises a first nucleic acid encoding a RNA-guided nuclease molecule and a second nucleic acid encoding a RMEM are disposed in the same vector or in two different vectors, each operably linked to its own promoter. In one embodiment, the vectors encoding a RNA-guided nuclease molecule and/or a RMEM described above can further comprise one or both of a gRNA molecule or a template nucleic acid.

In one embodiment, the vector is a viral vector, e.g., an adeno-associated virus (AAV) vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

Control sequences for use in an expression vector described herein include one or more of the following: promoters (e.g., constitutive, tissue or cell-specific, inducible, or repressible promoters), enhancers, signal sequences (e.g., nuclear localization sequence), selectable marker genes (e.g., antibiotic resistance or complementation of a deficiency in a metabolic pathway gene), transcriptional terminators, origin of replication, ribosome binding site, microRNA binding sites, mRNA regulatory sites and multiple cloning sites. Such control elements are described, for example, in Goeddel (1990) GENE EXPRESSION TECHNOLOGY: METHODS IN ENZYMOLOGY 185, Academic Press, San Diego, Calif. It will be appreciated by those skilled in the art that the design of the expression vector can depend on such factors as the choice of the host cell to be transformed, the level of expression desired, etc. Expression vectors can be designed for expression of the Cas9 molecule and/or the RMEM in prokaryotic or eukaryotic cells, e.g., bacterial cells, insect cells, yeast cells, or mammalian cells. Alternatively, the expression vector can be transcribed and translated in vitro, e.g., using T7 promoter regulatory sequences and a T7 promoter. In one embodiment, the expression vector is a viral vector.

Also provided herein are nucleic acids and vectors comprising encoding two RNA-guided nuclease molecules and a RMEM, wherein the first RNA-guided nuclease molecule is an eaCas9 molecule and the second RNA-guided nuclease is an is an eiCas9 molecule.

Expression and Production of RNA-Guided Nuclease Molecules and RMEMs

Also described herein are methods for producing RNA-guided nuclease molecules, e.g., Cas9 molecules, and/or RMEMs by expression in host cells. Vectors comprising nucleic acids encoding a RNA-guided nuclease molecule and/or a RMEM as described herein may be introduced and propagated in a host cell using the methods described herein.

The host cell may be a cell for the propagation of vectors comprising nucleic acids encoding a RNA-guided nuclease molecule and/or a RMEM for delivery to the subject, or for production of RNA-guided nuclease, e.g., Cas9, and/or RMEM polypeptides for delivery to the subject. The host cell may be a prokaryotic or a eukaryotic cell. The host cell may be a bacterial cell, a yeast cell, a plant cell, an insect cell, a mammalian cell, a primate cell, or a human cell. The selection of the particular host cell can depend on a variety of factors, including production capacity, ability to properly fold and process Cas9, or RMEM for maximal biological activity, the type of expression vector (e.g., control sequences) used, and amenability to large-scale production. In one embodiment, the host cell that produces the Cas9 and/or RMEM is a cell from the subject that is being treated.

Vectors for expression of the RNA-guided nuclease molecule and/or RMEM can be introduced into the host cell by any number of methods known in the art, including transformation, transfection, treatment of cells with $CaCl_2$, electroporation, lipofection, viral particle production and transduction, and PEG-mediated fusion of protoplasts. Host cells containing the vector, or nucleic acid encoding the RNA-guided nuclease molecule and/or RMEM can be selected, e.g., by utilizing the selectable marker of the expression vector, or an affinity tag. The host cells are grown under conditions suitable for induction and expression of the RNA-guided nuclease molecule and/or RMEM. Conditions will vary depending on the host cells used and can be readily determined by the ordinarily skilled artisan.

Methods for recovering the RNA-guided nuclease molecule and/or RMEM produced in the host cells can comprise one or more of the following steps: collecting the cells, e.g., by centrifugation or filtration; lysing the cells, e.g., by mechanical, chemical, or enzymatic means; and separating the desired RNA-guided nuclease molecule and/or RMEM from cell debris or other proteins or nucleic acids produced by the host cell. Cell lysis can be achieved through physically breaking apart the cells, e.g., by sonication, milling (shaking with beads), or shear forces. Alternatively, cell membranes can be permeabilized by treatment with detergents, e.g., Triton, NP-40, or SDS. Cell walls, e.g., of bacterial cells, can be permeabilized by treatment with enzymes, e.g., lysozyme or lysonase. Any combination of the mechanical, chemical, or enzymatic techniques described above are also suitable for recovering the RNA-guided nuclease molecule and/or RMEM in the context of this disclosure.

Methods for isolating or purifying desired molecules, e.g., RNA-guided nuclease molecules and/or RMEMs, are known in the art, e.g., size exclusion chromatography, ion exchange chromatography, affinity chromatography. In one embodiment, the RNA-guided nuclease and/or RMEM polypeptides comprise an affinity tag, e.g., a polyhistidine tag, a Myc tag, a FLAG tag, or a glutathione S-transferase (GST) tag. Affinity tags are short amino acid sequences that can be incorporated onto polypeptides and are recognized by affinity reagents that allow separation of the desired molecules from cellular debris or other proteins or nucleic acids produced by the host cell.

The present disclosure also provides cells comprising a RNA-guided nuclease molecule and/or a RMEM, as described herein, or at least one nucleic acid molecule, e.g., a vector, encoding a RNA-guided nuclease molecule and/or a RMEM described herein. In one embodiment, the cell further comprises one or both of a gRNA molecule or a template nucleic acid. Methods for delivering the RNA-guided nuclease molecule and/or the RMEM (or nucleic acid molecule encoding the RNA-guided nuclease molecule and/or the RMEM) to a cell, e.g., a host cell or a cell from a subject, are further described herein.

VIII. Functional Analysis of Candidate Molecules

Candidate RNA-guided nuclease, e.g., Cas9, molecules, candidate RMEMs, candidate gRNA molecules, and candidate Cas9/gRNA molecule complexes, can be evaluated by art-known methods or as described herein. For example, exemplary methods for evaluating the endonuclease activity of a Cas9 molecule are described, e.g., in Jinek et al. (2012) SCIENCE 337(6096): 816-821. The methods in this section may be used, e.g., to test various portions of a gRNA, for example, the targeting domain, the first complementarity domain, the linking domain, the second complementarity domain, the proximal domain, or the tail domain. In one embodiment, the methods in this section are tested to determine whether modifications made in one or more of these domains interfere with targeting efficacy. A gRNA with a selected length, sequence, degree of complementarity, or degree of modification, can be evaluated in a system of this section.

The methods in this section may be used to assess the functional capability of a candidate Cas9 molecule or a RMEM. The nuclease activity of the Cas9 molecule can be measured, e.g., the ability to mediate a nick, a single strand break, or a double strand break. The ability of the Cas9 molecule and/or RMEM to promote resection or a particular repair process, e.g., c-NHEJ, alt-NHEJ (including blunt EJ, MMEJ, and SD-MMEJ), and HDR (including alt-HR, HR, and SSA), can also be evaluated by using a functional assay described herein.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 µL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of a Cas9 Molecule to Target DNA

Exemplary methods for evaluating the binding of Cas9 molecule to target DNA are described, e.g., in Jinek et al. (2012).

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM MgCl2, 1 mM DTT and 10% glycerol in a total volume of 10 µl. Cas9 protein molecule is programmed with equimolar amounts of pre-annealed gRNA molecule and titrated from 100 µM to 1 µM. Radiolabeled DNA is added to a final concentration of 20 µM. Samples are incubated for 1 h at 37° C. and resolved at 4° C. on an 8% native polyacrylamide gel containing 1×TBE and 5 mM MgCl$_2$. Gels are dried and DNA visualized by phosphorimaging.

Differential Scanning Flourimetry (DSF)

The thermostability of Cas9 molecule-gRNA ribonucleoprotein (RNP) complexes, e.g., a Cas9 molecule-gRNA RNP complex, can be measured via DSF. This technique measures the thermostability of a protein, which can increase under favorable conditions such as the addition of a binding molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Technologies cat #S-6650) and dispensed into a 384 well plate. An equimolar amount of gRNA diluted in solutions with varied pH and salt is then added. After incubating at room temperature for 10 min. and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 uM Cas9 molecule in optimal buffer from the assay above and incubating at RT for 10 min in a 384 well plate. An equal volume of optimal buffer+10× SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 10 increase in temperature every 10 seconds.

Resection Assay: Testing the Ability of a Cas9 Molecule to Promote Resection

The ability of a Cas9 molecule to promote resection can be evaluated by measuring the levels of single stranded DNA at specific double strand break sites in human cells using quantitative methods (as described in Zhou et al. (2014) NUCLEIC ACIDS RES. 42(3): e19). In this assay, a candidate Cas9 molecule, or a candidate Cas9 molecule and a candidate RMEM, or at least one nucleic acid encoding the Cas9 molecule and/or RMEM, is delivered, e.g., by transfection, into the cell. The cells are cultured for a sufficient amount of time to allow nuclease activity and resection to occur. Genomic DNA is carefully extracted using a method in which cells are embedded in low-gelling point agar that protects the DNA from shearing and damage during extraction. The genomic DNA is digested with a restriction enzyme that selectively cuts double-stranded DNA. Primers for quantitative PCR that span up to 5 kb of the double strand break site are designed. The results from the PCR reaction show the levels of single strand DNA detected at each of the primer positions. Thus, the length and the level of resection promoted by the candidate Cas9 molecule, or the candidate Cas9 molecule in combination with the candidate RMEM, can be determined from this assay.

Other qualitative assays for identifying the occurrence of resection include the detection of proteins or protein complexes that bind to single-stranded DNA after resection has occurred, e.g., RPA foci, Rad51 foci, or BrDU detection by immunofluorescence. Antibodies for RPA protein and Rad51 are known in the art.

Repair Assays: Testing the Ability of a Cas9 Molecule to Promote DNA Repair

The ability of a Cas9 molecule to promote DNA repair by a HDR pathway, e.g., alt-HR, HR, or SSA, can be evaluated in a cell-based GFP assay. DNA repair by a HDR pathway is typically used to correct a gene with a mutation or undesired sequence. For this assay, a cell line carrying a non-functional GFP reporter system is used. An exogenous non-functional GFP gene, e.g., a GFP with an inactivating mutation, is delivered, e.g., by transfection, into a cell. Alternatively, the cell line carries one copy of a non-functional GFP gene integrated into the genome of the cell, e.g., by transduction. A candidate Cas9 molecule, or a candidate Cas9 molecule and a candidate RMEM, or at least one nucleic acid encoding the Cas9 molecule and/or RMEM, a gRNA that mediates binding of the Cas9 molecule to the GFP gene to be corrected, and a template nucleic acid containing a functional, e.g., corrected GFP gene sequence, is delivered, e.g., by transfection, into the cell. The cells are cultured for a sufficient amount of time to allow repair and expression of the GFP gene, and GFP expression is analyzed by flow cytometry. An increase in GFP-expressing (GFP-positive) cells or an increased level of GFP signal, as compared to control (e.g., cells carrying the non-functional GFP gene that did not receive Cas9 molecule, or Cas9 molecule and RMEM, or template nucleic acid), indicates that DNA repair occurred, resulting in gene correction. GFP positive cells can be collected by cell sorting methods, and further analyzed by various sequencing methods, e.g., MiSeq, HiSeq, or Sanger sequencing, to confirm correction of the targeted locus of the GFP gene.

Alternatively, the ability of a candidate Cas9 molecule, or a candidate Cas9 molecule and a candidate RMEM, or at least one nucleic acid encoding the Cas9 molecule and/or RMEM, to promote DNA repair by a NHEJ pathway, e.g., canonical NHEJ or ALT-NHEJ (including blunt EJ, MMEJ, and SD-MMEJ), can be evaluated in a cell-based GFP assay. DNA repair by the NHEJ pathways are typically used to disrupt a gene and prevent expression. For this assay, a cell line carrying a functional GFP reporter system is used. An exogenous functional GFP gene, e.g., a wild-type GFP gene, is delivered, e.g., by transfection, into a cell. Alternatively, the cell line carries one copy of a functional or wild-type GFP gene integrated into the genome of the cell, e.g., by transduction. A candidate Cas9 molecule, or a candidate Cas9 molecule and a candidate RMEM, or at least one nucleic acid encoding the Cas9 molecule and/or RMEM, and a gRNA that mediates binding of the Cas9 to the GFP gene is delivered, e.g., by transfection, into the cell. The cells are cultured for a sufficient amount of time to allow repair and expression of the GFP gene, and GFP expression is analyzed by flow cytometry. A decrease in GFP-expressing cells or a decrease in the level of GFP signal, as compared to control (e.g., cells carrying the functional GFP gene that did not received Cas9 molecule, or Cas9 molecule and RMEM), indicates that DNA repair occurred, resulting in gene disruption. GFP negative cells can be collected by cell sorting methods, and further analyzed by various sequencing methods, e.g., MiSeq, HiSeq, or Sanger sequencing, to confirm disruption of the targeted locus of the GFP gene.

The distinction between SSA and ALT-NHEJ, e.g., MMEJ, is based mostly on the read-out of the sequencing assay. SSA will result in increased resection, e.g., increased length of sequence that is resected, and more than 30 bases of homology at the break point. ALT-NHEJ, e.g., MMEJ, will result in less resection, e.g., shorter length of sequence that is resected, and between 5-25 bases of microhomology.

IX. Genome Editing Approaches

The present disclosure provides methods for genome editing, e.g., altering a target nucleic acid, e.g., altering the sequence, by utilizing a RNA-guided nuclease molecule, or a RNA-guided nuclease molecule and a RMEM, or at least one nucleic acid encoding the RNA-guided nuclease molecule and/or RMEM, described herein. In one embodiment, the target nucleic acid contains undesirable nucleic acid sequences, e.g., mutations, which can be repaired, e.g., corrected, by using a genome editing approach discussed herein. In an alternative embodiment, the target nucleic acid is disrupted, e.g., to prevent expression of a gene, by using a genome editing approach discussed herein. The different repair processes used in RNA-guided nuclease-mediated genome editing are discussed here.

In Cas9-mediated genome editing, a Cas9 molecule is localized to a target nucleic acid and mediates a break, e.g., a single strand or a double strand break, near or at a target position to be edited. The break is detected by endogenous DNA damage response machinery and the break is repaired by one of several DNA damage repair pathways. An RMEM, as described herein, is utilized to increase the efficiency of repair, or to increase the likelihood that the cell repairs the break using a particular DNA damage repair pathway. In this manner, one can control whether a target gene is corrected or disrupted. By delivering a Cas9 molecule, a gRNA molecule, and a RMEM to the cell, stimulation or an increase in the likelihood of one or more of the following processes: canonical NHEJ (c-NHEJ), alternative non-homologous end-joining (ALT-NHEJ), blunt end-joining (blunt EJ), microhomology mediated end-joining (MMEJ), synthesis dependent microhomology mediated end-joining (SD MMEJ), homology directed repair (HDR), homologous recombination (HR), single strand annealing (SSA), or alternative homologous recombination (alt-HR), occurring. In one embodiment, delivery of both a Cas9 molecule, a gRNA molecule, and a RMEM preferentially promotes one type of repair process over another, e.g., a canonical NHEJ pathway over a HDR pathway.

This section describes the machinery involved in different DNA repair pathways, and ways of modulating that machinery. It is believed that in many cases, promoting steps or factors involved in a first DNA repair pathway decreases the likelihood that a lesion will be repaired by another DNA repair pathway. Additional details on the DNA repair machinery are found in Ciccia and Elledge (2010) MOL. CELL 40(2): 179-204.

To begin, the relationships between different DNA damage repair pathways are described. When a cell encounters a DSB, it follows a two-step model. The first step is the choice between canonical NHEJ (sometimes abbreviated herein as C-NHEJ) which operates on blunt DNA ends (i.e., no resection), and the initiation of resection of the DNA at the site of the DSB. After the resection is engaged, the cell faces a choice between alternative non-homologous end-joining (Alt-NHEJ, which is a class of repair pathways that includes MMEJ) and HDR (which is a class of repair pathways that includes HR, alt-HR and SSA). KU70-80 is a protein complex that has affinity for double-strand breaks and it is one of the key factors that regulates canonical NHEJ, and it suppresses both HR and alt-NHEJ. The length of resection of the DNA and the state of the cell cycle have an important role in engaging HDR versus Alt-NHEJ. Specifically, longer resection is required for HDR (hundreds of nucleotides) whereas typically short resection is needed for Alt-NHEJ; HR is active in S and G2 instead Alt-NHEJ is active throughout the cell cycle.

Each pathway is described in more detail in the following sections and tables.

HDR-Mediated Repair

HDR is one of at least three repair pathways that act on double-stranded breaks (DSB). Which of the pathways ultimately repairs a given DSB is influenced by a number of factors, including the degree of resection at the break. HDR typically acts when there has been significant resection at the DSB, forming at least one single stranded portion of DNA. The other DSB repair pathways (canonical NHEJ, and alt-NHEJ) are discussed below. In addition to repairing DSBs, HDR (or a pathway sharing some of the same machinery) can also repair nicks when a nick is converted to a double strand break, e.g., after replication.

In some cases, a DSB is recognized by PARP1/2. PARP1/2 competes with Ku binding, and PARP1/2 binding favors engagement of the HDR machinery. Ku binding, in contrast, favors canonical NHEJ, as described below.

The DSB is also recognized by the MRN complex which contains MRE11, RAD50, and NBS1. MRE11 has 3' to 5' exonuclease activity and endonuclease activity. MRE11 form a complex with RAD50, which results in the increase of exonuclease activity. The second subunit, NBS1, recruits ATM to the break. Resection at the break is initiated by the BRCA1-C complex. In this complex, CtIP-interacting protein (CtIP, also known as Retinoblastoma binding protein 8, carboxy terminal binding protein-interacting protein, or RBBP8) has endonuclease activity and interacts with BRCA1 and MRN. An initial step in the resection pathway may occur when BRCA1 displaces 53BP1-RIF1, which would otherwise push the break into the canonical NHEJ pathway. Once MRN and CtIP are assembled, endonucleolytic cleavage of the 5' ends of the DSB creates short single-stranded 3' overhangs. Next, resection enters the processive stage due to the activities of EXO1 exonuclease (which has 3' to 5' exonuclease activity), and the Dna2 endonuclease. (Dna2 possesses several enzymatic activities, including 5' to 3' exonuclease activity, ATPase activity, and helicase activity.) The helicases RECQ1, BLM, WRN, RTS, RECQ4, and RECQ5 are human helicases involved in HDR. WRN has 3' to 5' helicase activity and exonuclease activity. BLM participates in replication and repair, unwinding both single strand and double stranded DNA in the 3' to 5' direction. During repair, BLM may also be involved in 5' end resection. RecQ protein-like 4 (RECQ4 or RECQL4) has 3' to 5' helicase activity. RecQ helicase-like (RECQL, RECQ1, or RECQL1) is a member of the RecQ helicase family and has 3' to 5' helicase activity. Together, these pro-resection components favor engagement of the HDR pathway.

Resection leads to the formation of single stranded DNA regions. These regions are bound and stabilized by RPA, a heterotrimer comprising RPA1, RPA2, RPA3, and RPA4 (see, for example, Mason et al., Biochemstry, 2010). An extended single strand can be repaired by the HDR pathway as discussed in this section, such as the SSA pathway which is discussed below. In the HDR pathway, the RPA heterotrimer undergoes post-translational modification, specifically PP4-dependent dephosphorylation of RPA2 and sumolyation of RPA1. RPA binding to the ssDNA generates a signal that has multiple consequence such as activation of the DNA damage response and ultimately the engagement of BRCA2. BRCA2 then acts to promote the RPA displacement and the consequential Rad51 loading onto the resected ends. CHK1 phosphorylates RAD51, allowing it to be recruited to the break. The Rad51 filament is a key factor involved in the search for homology and in promoting the D-loop invasion.

Repair can then progress via different DNA crossover intermediates, i.e., via the synthesis-dependent strand annealing (SDSA) pathway or by formation of double Holliday junctions (dHJs). Briefly, SDSA involves a DNA polymerase which lengthens the invading strand, and the RTEL helicase. When a dHJ is formed, the following machinery participates: BLM/TOPO III which dissolves the structure, an endonuclease such as FEN1, MUS81/EME1, or SLX1/SLX4 which cleaves the structure. (The FEN1 enzyme recognizes the specific DNA structure of 5' overhanging flap structures that occur in DNA repair and replication, e.g., processes 5' ends of Okazaki fragment during lagging strand synthesis. FEN1 may also possess 5' to 3' exonuclease activity on nicked or gapped double stranded DNA.)

In some embodiments, HDR results in physical integration of the template nucleic acid (or a part of it) into the genome as part of the repair process. In other embodiments, HDR does not result in physical integration of a part of the template nucleic acid into the genome.

FA (fanconi anemia) proteins may cause cells to favor HDR over canonical NHEJ.

HDR Pathways

HDR encompasses at least three pathways, homologous recombination (HR), alternative homologous recombination (alt-HR), and single strand annealing (SSA). Methods for promoting HDR pathways, e.g., alt-HR, SSA, and/or HR, by utilizing a Cas9 molecule, a gRNA molecule, and a RMEM are discussed herein. Briefly, HR refers to a type of HDR DNA-repair which typically acts occurs when there has been significant resection at the double strand break, forming at least one single stranded portion of DNA. In a normal cell, HR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

Alternative HR refers to the process of repairing DNA damage using a homologous nucleic acid (e.g., a sister chromatid or an exogenous nucleic acid, e.g., a template nucleic acid). ALT-HR is distinct from HR in that the process utilizes different pathways from canonical HR, and can be inhibited by the HR mediators, RAD51 and BRCA2. Also, ALT-HR uses a single-stranded or nicked homologous nucleic acid for repair of the break.

SSA refers to the process where RAD52 as opposed to RAD51 in the HR pathways, binds to the single stranded portion of DNA and promotes annealing of the two single stranded DNA segments at repetitive regions. Once RAD52 binds XFP/ERCC1 removes DNA flaps to make the DNA more suitable for ligation. SSA is described in more detail, below.

Exemplary Template Nucleic Acids

In one embodiment, the template nucleic acid is a single stranded nucleic acid. In another embodiment, the template nucleic acid is a double stranded nucleic acid. In one embodiment, the template nucleic acid comprises a nucleotide sequence, e.g., of one or more nucleotides, that will be added to or will template a change in the target nucleic acid. In one embodiment, the template nucleic acid comprises a nucleotide sequence that may be used to modify the target position. In one embodiment, the template nucleic acid comprises a nucleotide sequence, e.g., of one or more nucleotides, that corresponds to wild type sequence of the target nucleic acid, e.g., of the target position.

The template nucleic acid may comprise a replacement sequence. In one embodiment, the template nucleic acid comprises a 5' homology arm. In one embodiment, the template nucleic acid comprises a 3' homology arm.

In one embodiment, the template nucleic acid is linear double stranded DNA. The length may be, e.g., about 150-200 base pairs, e.g., about 150, 160, 170, 180, 190, or 200 base pairs. The length may be, e.g., at least 150, 160, 170, 180, 190, or 200 base pairs. In one embodiment, the length is no greater than 150, 160, 170, 180, 190, or 200 base pairs. In one embodiment, a double stranded template nucleic acid has a length of about 160 base pairs, e.g., about 155-165, 150-170, 140-180, 130-190, 120-200, 110-210, 100-220, 90-230, or 80-240 base pairs.

The template nucleic acid can be linear single stranded DNA. In one embodiment, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the transcribed strand of the target nucleic acid, (iv) linear single stranded DNA that can anneal to the non-transcribed strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In one embodiment, the length is no greater than 150, 160, 170, 180, 190, or 200 nucleotides. In one embodiment, a single stranded template nucleic acid has a length of about 160 nucleotides, e.g., about 155-165, 150-170, 140-180, 130-190, 120-200, 110-210, 100-220, 90-230, or 80-240 nucleotides.

In one embodiment, the template nucleic acid is circular double stranded DNA, e.g., a plasmid. In one embodiment, the template nucleic acid comprises about 500 to 1000 base pairs of homology on either side of the replacement sequence and/or the nick. In one embodiment, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In one embodiment, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In one embodiment, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In one embodiment, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In one embodiment, the template nucleic acid comprises about 150 to 1000 nucleotides of homology on either side of the replacement sequence and/or the nick. In one embodiment, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In one embodiment, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In one embodiment, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In one embodiment, the template nucleic acid is a lentiviral vector, e.g., an IDLV (integration deficiency lentivirus). In one embodiment, the template nucleic acid comprises about 500 to 1000 base pairs of homology on either side of the replacement sequence and/or the nick. In one embodiment, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In one embodiment, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In one embodiment, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In many embodiments, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In one embodiment, the template nucleic acid comprises at most 2, 3, 4, 5, 10, 20, 30, or 50 silent mutations relative to the corresponding sequence in the genome of the cell to be altered.

In one embodiment, the template nucleic acid alters the structure of the target position by participating in a homology directed repair event. In one embodiment, the template nucleic acid alters the sequence of the target position. In one embodiment, the template nucleic acid results in the incorporation of a modified, or non-naturally occurring base into the target nucleic acid.

Typically, the template sequence undergoes a breakage mediated or catalyzed recombination with the target sequence. In one embodiment, the template nucleic acid includes sequence that corresponds to a site on the target sequence that is cleaved by an eaCas9 mediated cleavage event. In one embodiment, the template nucleic acid includes sequence that corresponds to both, a first site on the target sequence that is cleaved in a first Cas9 mediated event, and a second site on the target sequence that is cleaved in a second Cas9 mediated event.

In one embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In one embodiment, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position can be used to alter the structure of a target sequence. The template sequence can be used to alter an unwanted structure, e.g., an unwanted or mutant nucleotide.

Length Of The Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In one embodiment, a homology arm does not extend into repeated elements, e.g., ALU repeats or LINE repeats.

Exemplary homology arm lengths include a least 50, 100, 250, 500, 750, 1000, 2000, 3000, 4000, or 5000 nucleotides. In one embodiment, the homology arm length is 50-100, 100-250, 250-500, 500-750, 750-1000, 1000-2000, 2000-3000, 3000-4000, or 4000-5000 nucleotides.

A template nucleic acid typically comprises the following components: [5' homology arm]-[replacement sequence]-[3' homology arm].

The homology arms provide for recombination into the chromosome, thus replacing the undesired element, e.g., a mutation or signature, with the replacement sequence. In one embodiment, the homology arms flank the most distal cleavage sites.

In one embodiment, the 3' end of the 5' homology arm is the position next to the 5' end of the replacement sequence. In one embodiment, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In one embodiment, the 5' end of the 3' homology arm is the position next to the 3' end of the replacement sequence. In one embodiment, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In one embodiment, to correct a mutation, the homology arms, e.g., the 5' and 3' homology arms, may each comprise about 1000 base pairs (bp) of sequence flanking the most distal gRNAs (e.g., 1000 bp of sequence on either side of the mutation).

It is contemplated herein that one or both homology arms may be shortened to avoid including certain sequence repeat elements, e.g., Alu element or LINE elements. For example, a 5' homology arm may be shortened to avoid a sequence repeat element. In one embodiment, a 3' homology arm may be shortened to avoid a sequence repeat element. In one embodiment, both the 5' and the 3' homology arms may be shortened to avoid including certain sequence repeat elements.

It is contemplated herein that template nucleic acids for correcting a mutation may be designed for use as a single-stranded oligonucleotide, e.g., a single-stranded oligodeoxynucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made. In one embodiment, a longer homology arm is made by a method other than chemical synthesis, e.g., by denaturing a long double stranded nucleic acid and purifying one of the strands, e.g., by affinity for a strand-specific sequence anchored to a solid substrate.

Exemplary Arrangements of Linear Nucleic Acid Template Systems

In one embodiment, the nucleic acid template system is double stranded. In one embodiment, the nucleic acid template system is single stranded. In one embodiment, the nucleic acid template system comprises a single stranded portion and a double stranded portion. In one embodiment, the template nucleic acid comprises about 50 to 100, e.g., 55 to 95, 60 to 90, 65 to 85, or 70 to 80, base pairs, homology on either side of the nick and/or replacement sequence. In one embodiment, the template nucleic acid comprises about 50, 55, 60, 65, 70, 75, 80, 85, 90, 95, or 100 base pairs homology 5' of the nick or replacement sequence, 3' of the nick or replacement sequence, or both 5' and 3' of the nick or replacement sequences.

In one embodiment, the template nucleic acid comprises about 150 to 200, e.g., 155 to 195, 160 to 190, 165 to 185, or 170 to 180, base pairs homology 3' of the nick and/or replacement sequence. In one embodiment, the template nucleic acid comprises about 150, 155, 160, 165, 170, 175, 180, 185, 190, 195, or 200 base pairs homology 3' of the nick or replacement sequence. In one embodiment, the template nucleic acid comprises less than about 100, 90, 80, 70, 60, 50, 40, 30, 20, 15, or 10 base pairs homology 5' of the nick or replacement sequence.

In one embodiment, the template nucleic acid comprises about 150 to 200, e.g., 155 to 195, 160 to 190, 165 to 185, or 170 to 180, base pairs homology 5' of the nick and/or replacement sequence. In one embodiment, the template nucleic acid comprises about 150, 155, 160, 165, 170, 175, 180, 185, 190, 195, or 200 base pairs homology 5' of the nick or replacement sequence. In one embodiment, the template nucleic acid comprises less than about 100, 90, 80, 70, 60, 50, 40, 30, 20, 15, or 10 base pairs homology 3' of the nick or replacement sequence.

Exemplary Arrangements of Circular Nucleic Acid Template Systems

In one embodiment, the nucleic acid template system is double stranded. In one embodiment, the nucleic acid template system is double stranded comprises a single stranded portion and a double stranded portion. In one embodiment, the nucleic acid template system is single stranded.

In one embodiment, the template nucleic acid comprises about 500 to 2000, e.g., 700 to 1900, 800 to 1800, 900 to 1700, 900 to 1600, 1000 to 1500, 1100 to 1400, or 1200 to 1300 base pairs, homology on either side of the nick and/or replacement sequence. In one embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence, 3' of the nick or replacement sequence, or both 5' and 3' of the nick or replacement sequences.

In one embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 3' of the nick and/or replacement sequence. In one embodiment, the template nucleic acid comprises about 500, 600, 700, 800, 900, 1000, 1100, 1200, 1300, 1400, 1500, 1600, 1700, 1800, 1900, or 2000 base pairs homology 3' of the nick or replacement sequence. In one embodiment, the template nucleic acid comprises less than about 500, 400, 300, 200, 100, or 50 base pairs homology 5' of the nick or replacement sequence.

In one embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 5' of the nick and/or replacement sequence. In one embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence. In one embodiment, the template nucleic acid comprises less than about 500, 400, 300, 200, 100, or 50 base pairs homology 3' of the nick or replacement sequence.

Additional details on template nucleic acids are provided in Section IV entitled "Template Nucleic Acids (Genome Editing Approaches)" of PCT Application WO 2015/048577, the entire contents of which are expressly incorporated herein by reference.

HDR and the Cell Cycle

HDR is highly influenced by the stage of the cell cycle. Cell cycle regulation acts on several points of the pathway, which are discussed below.

First, in the wild-type context, HDR is thought to be limited to S and G2 phase because HDR requires RAD51 to interact with the C-terminus of BRCA2, and this interaction only occurs during S and G2 phases.

In addition, cell cycle-dependent differences in resection may help limit homologous recombination to S/G2. In mammals, to promote HDR, the resecting endonuclease CtIP is activated by CDK phosphorylation at threonine 847. A further phosphorylation on serine 327 promotes CtIP's interaction with the BRCT domain of BRCA1 (which is important for HDR). In a mutually antagonistic arrangement, BRCA1-CtIP favors homologous recombination by antagonizing 53BP1-RIF1 in G2, whereas in G1, 53BP1-RIF2 blocks BRCA1 from accumulating at DSBs. Resection involves not only nucleases but helicases. Helicases are motor proteins that move along the backbone of the DNA and alter the structure of DNA by unwinding DNA or promoting the annealing of single strands. Unwinding of the DNA occurs through an ATP-dependent process that breaks the hydrogen bonds between the nucleotides of annealed strands, e.g., through ATP hydrolysis. Unwinding activity can occur in the 5' to 3' direction or in the 3' to 5' direction. Helicase activity also includes promoting ATP-independent or ATP-dependent annealing of two single strands with significant or sufficient complementarity. The helicase BLM also undergoes cell-cycle dependent regulation. More particularly, sumoylation of BLM appears to promote recombination.

The stage of the cell cycle also affects the formation of the RAD51 filament. For instance, RPA (which forms a substrate for assembly of the RAD51 filament) is phosphorylated in a cell cycle dependent manner, affecting its ability to localize properly. In addition, RAD51 is more directly regulated; the CHK1 kinase phosphorylates it, allowing it to form foci at the sites of DNA damage and promote repair. As an additional form of regulation, CDK-cyclin A phosphorylates BRCA2 in M phase, preventing BRCA2 from interacting with RAD51, effectively shutting down HDR at the end of G2 phase.

In addition, the MRN complex may also be a target of cell cycle dependent regulation.

Non-Homologous End-Joining (NHEJ)

Two distinct NHEJ pathways are described herein, canonical NHEJ and alternative NHEJ (alt-NHEJ). In contrast to HDR, canonical NHEJ typically occurs when a double strand break has blunt, unresected ends that are ligation-competent. In some instances, minimal end processing, e.g., <5 nucleotide deletions or insertions, occurs, and the break ends are ligated thereby resulting in either correct (error-free) repair, or approximately 1-4 nucleotide insertions or deletions. Canonical NHEJ is dependent upon the KU70/80 and XRCC4/LigaseIV pathway for recognition of the break, minimal end processing, DNA synthesis, and ligation.

In contrast, alternative NHEJ (Alt-NHEJ) appears to encompass a variety of different DNA repair processes, including blunt EJ, MMEJ, and SD-MMEJ. The common feature is that alt-NHEJ is independent from KU70/80 and Xrcc4/Ligase IV, and is associated with deletion at the repair junctions. Alt-NHEJ typically occurs when resection of more than 5 nucleotides at the break ends occurs. In some cases, resection reveals a short span, e.g., 5 to 25 nucleotides, of homologous sequence in the overhangs, also known as microhomologies. The microhomologies anneal and the intervening sequence on the single strands between the break and the annealed microhomology region is deleted. Accordingly, ALT-NHEJ typically results in longer stretches, e.g., greater than 5 nucleotides, of deleted sequence than canonical NHEJ.

Alternative NHEJ has different subclasses, including blunt end-joining (blunt EJ), MMEJ (microhomology mediated end-joining), and SD-MMEJ (synthesis dependent micro homology mediated end-joining), and others that do not have specific names but are characterized by not having any microhomology at the break-point. In MMEJ, a limited amount of resection occurs and there is microhomology at the break site (typically 5-25 bp); MMEJ is one of the most abundant and characterized types of alt-NHEJ. The initial phase of MMEJ involves recognition of the break. PARP1/2, which binds to double strand breaks, can promote MMEJ. Next, the cell performs resection over a short distance from the break site. CtIP performs some resection in G1, which can also promote MMEJ. Next, the single stranded microhomology domains anneal with each other and LIG-3 performs DNA end ligation. In SDMMEJ, there is de novo synthesis by an accurate non-processive DNA polymerase that creates microhomology.

Alt-NHEJ is mostly independent from DNAPk (a key participant in canonical NHEJ, as discussed above), and is instead dependent on the MRN complex (composed of MRE11, Rad50 and Nbs1) and CtIP, both of which participate in resection.

Alt-NHEJ is cell cycle independent; it can occur in G1, where limited resection is present and exposes the microhomology or, alternatively, a helicase might expose the microhomology (as occurs in MMEJ). Polymerases can fill in the gap and the XPF/ERCC1 complex (which is an endonuclease component also involved in NER and SSA) has a role in removing the DNA flap (the displaced strand that gets created). Finally, ligase I and a complex of XRCC1 and ligase III appear to have a role in the ligation of the ends. The latter two factors are also involved in NER, BER and SSBR.

Nuclease-induced non-homologous end-joining (NHEJ) can be used to target gene-specific knockouts. Nuclease-induced NHEJ can also be used to remove (e.g., delete) nucleotide sequence in a gene of interest. In the methods for altering a cell or treating a subject by altering a cell described herein, the cell is contacted with a Cas9 molecule, at least one gRNA molecule, and a RMEM described herein in an amount and under conditions sufficient for NHEJ. In one embodiment, a deletion occurs in the nucleic acid of the cell, thereby altering the sequence of the nucleic acid of the cell.

In one embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, e.g., resection, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. In one embodiment, the deletion is at least about 1, 2, 3, 4, 5, 6, 7, 8, 9, 10, 11, 12, 13, 14, 15, 16, 17, 18, 19, 20, 30, 40, 47, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, 1000000 or more nucleotides in length. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene of interest, can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Methods for promoting NHEJ pathways, particularly alternative NHEJ, by utilizing a Cas9 molecule and a RMEM are discussed herein.

Single Strand Annealing (SSA)

Single strand annealing (SSA) is a that repairs double-stranded breaks. SSA is believed to be a sub-branch of HDR. As with HDR, a cell typically uses SSA when there has been significant resection at the break. Thus, SSA is characterized by having longer length of resection (longer than Alt-NHEJ) and a longer stretch of homology at the DSB site (>30 bp). SSA competes with HR in S phase.

As in other HDR pathways, resection leads to the formation of single stranded DNA regions. These regions are bound and stabilized by RPA, a heterotrimer comprising RPA1, RPA2, and RPA3. Whereas in the other HDR pathways, RAD51 binds the single stranded region, in the SSA pathway, RAD52 is involved. RAD52 promotes annealing of the two single stranded DNA segments at repetitive regions. Next, XPF/ERCC1 removes DNA flaps to make the DNA more suitable for ligation. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized. SSA results in disruption of the target nucleic acid sequence.

Methods for promoting SSA by utilizing a gRNA molecule, a Cas9 molecule, and a RMEM are discussed herein.

Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott (2008) NATURE REVIEWS GENETICS 9: 619-631, and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase β, DNA polymerase delta, DNA polymerase epsilon, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleaseses remove the lesion and leave a 1-30 nucleotide gap that is sub-sequentially filled in by DNA polymerase and finally sealed with ligase. A more complete picture is given in Li (2008) CELL RESEARCH 18: 85-98, and a summary is provided here.

Mismatch repair (MMR) operates on mispaired DNA bases.

The MSH2/6 or MSH2/3 complexes both have ATPase activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLα which possesses an ATPase activity and is important for multiple steps of MMR. It possesses a PCNA/replication factor C (RFC)-dependent endonuclease activity which plays an important role in 3' nick-directed MMR involving EXO1 (EXO1 is a participant in both HR and MMR). It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol delta, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott (2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE 1) or bifunctional DNA glycosylases with an associated lyase activity incises the phosphodiester backbone to create a DNA single strand break (SSB). The third step of BER involves cleaning-up of the DNA ends. The fourth step in BER is conducted by Pol β that adds a new complementary nucleotide into the repair gap, and in the final step, XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β, there is then a polymerase switch to the replicative DNA polymerases, Pol 6/c, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Pol β, Pol delta, Pol epsilon, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al. (2014) NATURE REVIEWS MOLECULAR CELL BIOLOGY 15, 465-481, and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol 6, DNA Pol e or DNA Pol K, and DNA ligase I or XRCC1/Ligase III. Replicating cells tend to use DNA pol e and DNA ligase I, while non-replicating cells tend to use DNA Pol 6, DNA Pol K, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1, and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol and Rev1.

Error-free postreplication repair (PRR) is another pathway for repairing a single stranded break left after a defective replication event.

Methods for Promoting Specific Repair Processes

Methods for promoting specific repair processes, e.g., preferentially over a different repair process, by utilizing a Cas9 molecule, at least one gRNA molecule, and a RMEM are described herein. In one embodiment, the Cas9 molecule has specific functional properties, e.g., a Cas9 molecule comprising nickase or double strand cleavage activity, and can promote one repair process in favor of another. In an aspect, the use of a combination of Cas9, at least one gRNA molecule, and a RMEM, described herein mediates, or preferentially promotes, one or more of the following repair processes: c-NHEJ, alt-NHEJ (including blunt EJ, MMEJ, and SD-MMEJ), or HDR (including alt-HR, HR, and SSA).

As described above, resection plays an important role in HDR (including SSA, HR, and alt-HR), and alt-NHEJ. In some embodiments, the repair process stimulated after Cas9-mediated cleavage is dependent upon the degree, e.g., the length, of resection. For example, SSA is stimulated only when the resection sufficiently exposes two direct repeat sequences competent for single strand annealing.

In one embodiment, the methods provided herein promote HDR. HDR may require the presence of a template nucleic acid. The template nucleic acid may be exogenous, e.g., provided to the cell or to the subject, or may be endogenous, e.g., naturally occurring in the cell or the subject. The template nucleic acid may be double stranded, single stranded, or nicked. Exemplary template nucleic acids are described herein. In one embodiment, where the template nucleic acid is double-stranded, HDR is promoted. In another embodiment, SSA does not require the presence of a template nucleic acid.

In one embodiment, the methods provided herein promote canonical NHEJ. In one embodiment, canonical NHEJ does not require the presence of a template nucleic acid. In another embodiment, the methods provided herein promote ALT-NHEJ. ALT-NHEJ does not require the presence of a template nucleic acid.

Combinations of RNA-Guided Nuclease Molecules and RMEMs

A RMEM, e.g., an endogenous or a heterologous RMEM, can be used in combination with different RNA-guided nuclease molecules. For example, a RMEM, e.g., an endogenous or a heterologous RMEM, can be used in combination with an eiCas9 molecule, or in combination with an eaCas9 molecule, or in combination with two or more Cas9 molecules that may be eaCas9 molecules or eiCas9 molecules. In one embodiment where the combination comprises a RMEM, e.g., an endogenous or a heterologous RMEM, and two Cas9 molecules, the first and second Cas9 molecules are different, e.g., have different functional activity or have different amino acid sequences. In one embodiment where the combination comprises a RMEM, e.g., an endogenous or a heterologous RMEM, and more than two Cas9 molecules, the Cas9 molecules are also different.

In another embodiment, a RNA-guided nuclease molecule may be used in combination with different RMEMs. For example, a Cas9 molecule can be used in combination with one or more RMEMs. In one embodiment where the combination comprises a Cas9 molecule and two or more RMEMs, the RMEMs are different, e.g., have different functional activity or have different amino acid sequences. Embodiments where two or more Cas9 molecules, e.g., three, four, five, six, seven or more Cas9 molecules, are used in combination with two or more RMEMs, e.g., three, four, five, six, seven or more RMEMs, are also envisioned.

In the methods where a cell is contacted with a combination comprising a RMEM, and two or more RNA-guided nuclease molecules, e.g., an eiCas9 molecule and an eaCas9 molecule, the combination further comprises a gRNA corresponding to each of the Cas9 molecules in the combination. For example, in the combination of an eaCas9 molecule and an eiCas9 molecule, the combination further comprises two gRNA molecules, where the gRNA molecule that forms a complex with the eaCas9 molecule is only functional with the eaCas9 molecule, e.g., does not form a complex with the eiCas9 molecule. Similarly, the gRNA molecule that forms a complex with the eiCas9 molecule is only functional with the eiCas9 molecule, e.g., does not form a complex with the eaCas9 molecule. In one embodiment, the gRNA molecule that correspond to the eaCas9 molecule positions the eaCas9 molecule so that the cleavage event mediated by the eaCas9 molecule is at a preselected position on the target nucleic acid. In one embodiment, the gRNA molecule that corresponds to the eiCas9 molecule positions the eiCas9 away from the preselected position on the target nucleic acid, e.g., at least 10, 50, 100, 200, 300, 400, 500, 600, 700, 800, 900, or 1000 nucleotides from the preselected position, or within 10, 50, 100, 200, 300, 400, 500, 600, 700, 800, 900, or 1000 nucleotides of the preselected position. In one embodiment the amount of eiCas9 delivered is at least 2, 3, 4, 5, 10, 20, 30, 40, 50, or 100-fold higher than the amount of eaCas9 molecule that is delivered to the cell or the subject. Thus, In one embodiment, a plurality of eiCas9 molecules are localized to the target nucleic acid at varying or regular intervals on either or both sides of the preselected position at which the eaCas9 molecule-mediated cleavage event will occur. In one embodiment, a complex comprising the eiCas9 molecule and its gRNA, and a complex comprising the eaCas9 molecule and its gRNA, are contacted with, or administered to a cell.

Types of Cleavage Events in Genome Editing

In one embodiment, a mutation can be corrected by either one double-strand break or two single strand breaks. In one embodiment, a mutation can be corrected by (1) a single double-strand break, (2) two single strand breaks, (3) two double stranded breaks with a break occurring on each side of the target position, (4) one double stranded break and two single strand breaks with the double strand break and two single strand breaks occurring on each side of the target position or (5) four single stranded breaks with a pair of single stranded breaks occurring on each side of the target position.

Double Strand Break Mediated Correction

In one embodiment, double strand cleavage is effected by a Cas9 molecule having cleavage activity associated with an HNH domain and cleavage activity associated with a RuvC domain. Such embodiments require only a single gRNA.

Single Strand Break Mediated Correction

In some embodiments, one single strand break, or nick, is effected by a Cas9 molecule having nickase activity, e.g., a Cas9 nickase as described herein.

In one embodiment, two single strand breaks, or nicks, are effected by a Cas9 molecule having nickase activity, e.g., cleavage activity associated with an HNH domain or cleavage activity associated with a RuvC domain. Such embodiments usually require two gRNAs, one for placement of each single strand break. In one embodiment, the Cas9 molecule having nickase activity cleaves the strand to which the gRNA hybridizes, but not the strand that is complementary to the strand to which the gRNA hybridizes. In one embodiment, the Cas9 molecule having nickase activity does not cleave the strand to which the gRNA hybridizes, but rather cleaves the strand that is complementary to the strand to which the gRNA hybridizes.

In one embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In one embodiment, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). Alternatively, a Cas9 molecule may have a mutation at N863, e.g., an N863A mutation.

In one embodiment, in which a nickase and two gRNAs are used to position two single strand nicks, one nick is on the + strand and one nick is on the − strand of the target nucleic acid. The PAMs are outwardly facing. The gRNAs can be selected such that the gRNAs are separated by, from about 0-50, 0-100, or 0-200 nucleotides. In one embodiment, there is no overlap between the target sequences that are complementary to the targeting domains of the two gRNAs. In one embodiment, the gRNAs do not overlap and are separated by as much as 50, 100, or 200 nucleotides. In one embodiment, the use of two gRNAs can increase specificity, e.g., by decreasing off-target binding (Ran et al. (2013) CELL 154: 1380-1389).

In one embodiment, a single nick can be used to induce HDR. It is contemplated herein that a single nick can be used to increase the ratio of HR to NHEJ at a given cleavage site. In one embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

Placement of the Double Strand Break or a Single Strand Break Relative to Target Position or Other Landmark The double strand break or single strand break in one of the strands should be sufficiently close to target position such that an alteration is produced in the desired region, e.g., correction of a mutation occurs. In one embodiment, the distance is not more than 50, 100, 200, 300, 350 or 400 nucleotides. It is believed that the break should be sufficiently close to target position such that the target position is within the region that is subject to exonuclease-mediated removal during end resection. If the distance between the target position and a break is too great, the mutation or other sequence desired to be altered may not be included in the end resection and, therefore, may not be corrected, as donor sequence In one embodiment may only be used to correct sequence within the end resection region.

In one embodiment, the targeting domain is configured such that a cleavage event, e.g., a double strand or single strand break, is positioned within 1, 2, 3, 4, 5, 7, 8, 9, 10, 11, 12, 13, 14, 15, 16, 17, 18, 19, 20, 25, 30, 35, 40, 45, 50, 60, 70, 80, 90, 100, 150 or 200 nucleotides of the region desired to be altered, e.g., a mutation. The break, e.g., a double strand or single strand break, can be positioned upstream or downstream of the region desired to be altered, e.g., a mutation. In one embodiment, a break is positioned within the region desired to be altered, e.g., within a region defined by at least two mutant nucleotides. In one embodiment, a break is positioned immediately adjacent to the region desired to be altered, e.g., immediately upstream or downstream of a mutation.

In one embodiment, a single strand break is accompanied by an additional single strand break, positioned by a second gRNA molecule, as discussed below. For example, the targeting domains are configured such that a cleavage event, e.g., the two single strand breaks, are positioned within 1, 2, 3, 4, 5, 6, 7, 8, 9, 10, 11, 12, 13, 14, 15, 16, 17, 18, 19, 20, 25, 30, 35, 40, 45, 50, 60, 70, 80, 90, 100, 150 or 200 nucleotides of a target position. In one embodiment, the first and second gRNA molecules are configured such, that when guiding a Cas9 nickase, a single strand break will be accompanied by an additional single strand break, positioned by a second gRNA, sufficiently close to one another to result in alteration of the desired region. In one embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In one embodiment, the two gRNA molecules are configured to position cuts at the same position, or within a few nucleotides of one another, on different strands, e.g., essentially mimicking a double strand break.

In one embodiment, in which a gRNA (unimolecular (or chimeric) or modular gRNA) and Cas9 nuclease induce a double strand break for the purpose of inducing HDR-mediated correction, the cleavage site is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In one embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, the targeting domain of a gRNA molecule is configured to position a cleavage event sufficiently far from a preselected nucleotide, e.g., the nucleotide of a coding region, such that the nucleotide is not altered. In one embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In one embodiment, a double strand break can be accompanied by an additional double strand break, positioned by a second gRNA molecule, as is discussed below.

In one embodiment, a double strand break can be accompanied by two additional single strand breaks, positioned by a second gRNA molecule and a third gRNA molecule.

In one embodiment, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, it is contemplated that the two or more cleavage events may be made by the same or different Cas9 molecules. For example, when two gRNAs are used to position two double stranded breaks, a single Cas9 molecule may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 molecules may be used, e.g., one Cas9 nuclease and one Cas9 nickase. It is contemplated that when two or more Cas9 molecules are used that the two or more Cas9 molecules may be delivered sequentially to control specificity of a double stranded versus a single stranded break at the desired position in the target nucleic acid.

In one embodiment, the targeting domain of the first gRNA molecule and the targeting domain of the second gRNA molecules are complementary to opposite strands of the target nucleic acid molecule. In one embodiment, the gRNA molecule and the second gRNA molecule are configured such that the PAMs are oriented outward.

In one embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-55 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp) and no more than 100 bp away from each other (e.g., no more than 90, 80, 70, 60, 50, 40, 30, 20, 10 or 5 bp away from each other). In one embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, In one embodiment, within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

When two gRNAs are used to target Cas9 molecules to breaks, different combinations of Cas9 molecules are envisioned. In one embodiment, a first gRNA is used to target a first Cas9 molecule to a first target position, and a second gRNA is used to target a second Cas9 molecule to a second target position. In one embodiment, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In one embodiment, a RuvC-like domain cleaves the non-complementary strand of the target nucleic acid molecule. In one embodiment, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In one embodiment, a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, In one embodiment, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC domain will cleave the non-complementary strand and the Cas9 molecule with the HNH domain will cleave the complementary strand, resulting in a double stranded break.

X. Target Cells

A RNA-guided nuclease molecule and/or a RMEM, and, optionally, one or both of at least one gRNA molecule, and a template nucleic acid, can be used to manipulate a cell, e.g., to alter the nucleic acid at a target position, in a wide variety of cells. Additional details on types of cells that can be manipulated may be found in the section entitled "VIIA. TARGETS: CELLS" of PCT Application WO 2015/048577, the entire contents of which are expressly incorporated herein by reference.

In some embodiments, a cell, or a population of cells, is manipulated by editing (e.g., introducing a mutation or correcting) one or more target genes, e.g., as described herein. In one embodiment, a cell, or a population of cells, is manipulated by editing one or more non-coding sequences, e.g., an alteration in an intron or in a 5' or 3' non-translated or non-transcribed region. In one embodiment, a cell is manipulated by editing the sequence of a control element, e.g., a promoter, enhancer, or a cis-acting or trans-acting control element. In one embodiment, a cell, or a population of cells, is manipulated by editing one or more coding sequences, e.g., an alteration in an exon. In some embodiments, a cell, or a population of cells, is manipulated in vitro. In other embodiments, a cell, or a population of cells, is manipulated ex vivo. In some embodiments, a cell, or a population of cells, is manipulated in vivo. In some embodiments, the expression of one or more target genes (e.g., one or more target genes described herein) is modulated, e.g., in vivo. In other embodiments, the expression of one or more target genes (e.g., one or more target genes described herein) is modulated, e.g., ex vivo. In other embodiments, the expression of one or more target genes (e.g., one or more target genes described herein) is modulated, e.g., in vitro.

In some embodiments, the cell, or population of cells, is a T cell, e.g., a $CD8^+$ T cell (e.g., a $CD8^+$ naïve T cell, central memory T cell, or effector memory T cell), a $CD4^+$ T cell, a stem cell memory T cell, a helper T cell, a regulatory T cell, a cytotoxic T cell, a natural killer T cell, or a population of such cells.

In some embodiments, the cell, or population of cells, is a hematopoietic stem cell (e.g., a long term hematopoietic stem cell (LT-HSC), a short term hematopoietic stem cell (ST-HSC), a multipotent progenitor (MPP) cell, a lineage restricted progenitor (LRP) cell (e.g., a lymphoid progenitor cell, a myeloid progenitor cell (e.g., a common myeloid progenitor (CMP) cell), an erythroid progenitor cell (e.g., a megakaryocyte erythroid progenitor (MEP) cell)), or a population of such cells.

In some embodiments, the cell, or population of cells, is a retinal cell (e.g., a photoreceptor cell (e.g., a rod cell, a cone cell) a retinal pigmented epithelium (RPE) cell), a trabecular meshwork cell, or a population of such cells.

In some embodiments, the cell, or population of cells, is a cochlear hair cell (e.g., an outer hair cell or an inner hair cell), or a population of cochlear hair cells.

In some embodiments, the cell, or population of cells, is a pulmonary epithelial cell (e.g., a bronchial epithelial cell or an alveolar epithelial cell), a pulmonary epithelial progenitor cell, or a population of such cells.

In some embodiments, the cell, or population of cells, is a striated muscle cell, a cardiac muscle cell, a muscle satellite cell, or a population of such cells. In some embodiments, the cell, or population of cells, is a neuron, a neuronal stem cell, or a population of such cells. In some embodiments, the cell, or population of cells, is a mesenchymal stem cell, or a population of mesenchymal stem cells. In some embodiments, the cell, or population of cells, is an induced pluripotent stem (iPS) cell, or a population of iPs cells. In some embodiments, the cell, or population of cells, is an embryonic stem cell, or a population of embryonic stem cells. In some embodiments, the cell, or population of cells, is a monocyte, a megakaryocyte, a neutrophil, an eosinophil, a basophil, a mast cell, a reticulocyte, or a population of such cells. In some embodiments, the cell, or population of cells, is a B cell, e.g., a progenitor B cell, a Pre B cell, a Pro B cell, a memory B cell, or a plasma B cell, or a population of B cells. In some embodiments, the cell, or population of cells, is a gastrointestinal epithelial cell, a biliary epithelial cell, a pancreatic ductal epithelial cell, an intestinal stem cell, or a population of such cells. In some embodiments, the cell, or population of cells, is a hepatocyte, a liver stellate cell, a Kupffer cell, or a population of such cells. In some embodiments, the cell, or population of cells, is an osteoblast, an osteoclast, or a population of such cells. In some embodiments, the cell, or population of cells, is an adipocyte, a preadipocyte, or a population of such cells. In some embodiments, the cell, or population of cells, is a pancreatic islet cell (e.g., a beta cell, an alpha cell, or a delta cell), a pancreatic exocrine cell, or a population of such cells. In some embodiments, the cell, or population of cells, is a Schwann cell, an oligodendrocyte, or a population of such cells.

In some embodiments, the cells are manipulated (e.g., converted or differentiated) from one cell type to another. In some embodiments, a pancreatic cell is manipulated into a beta islet cell. In some embodiments, a fibroblast is manipulated into an iPS cell. In some embodiments, a preadipocyte is manipulated into a brown fat cell. Other exemplary cells include, e.g., muscle cells, neural cells, leukocytes, and lymphocytes. In some embodiments, the cell being manipulated is selected from fibroblasts, monocytic precursors, B cells, exocrine cells, pancreatic progenitors, endocrine progenitors, hepatoblasts, myoblasts. In some embodiments, the cell is manipulated (e.g., converted or differentiated) into muscle.

In some embodiments, a nucleic acid at one or more target positions in a cell, or a population of cells, is altered e.g., as described herein. In some embodiments, a nucleic acid at one or more target positions in a cell, or a population of cells (e.g., target positions at one or more genes described herein) is altered, e.g., in vivo. In other embodiments, a nucleic acid at one or more target positions in a cell, or a population of cells (e.g., target positions at one or more genes described herein) is altered, e.g., ex vivo. The Cas9 molecule, nucleic acid template system, and/or gRNA molecules described herein can be delivered to a cell or to a population of cells.

In some embodiments, the cell, or the population of cells, is a T cell, a CD8$^+$ T cell, a CD8$^+$ naïve T cell, a central memory T cell, an effector memory T cell, a CD4$^+$ T cell, a stem cell memory T cell, a helper T cell, a regulatory T cell, a cytotoxic T cell, a natural killer T cell, a hematopoietic stem cell, a long term hematopoietic stem cell, a short term hematopoietic stem cell, a multipotent progenitor cell, a lineage restricted progenitor cell, a lymphoid progenitor cell, a pancreatic progenitor cell, an endocrine progenitor cell, an exocrine progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a hepatoblast, a myoblast, a macrophage, an islet beta-cell, a cardiomyocyte, a blood cell, a ductal cell, an acinar cell, an alpha cell, a beta cell, a delta cell, a PP cell, a cholangiocyte, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a pre B cell, a pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte (e.g., a brown adipocyte, or a white adipocyte), a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte, or a population of such cells.

In some embodiments, the cell, or the population of cells, is a mammalian cell, e.g., a human cell, a mouse cell, a rat cell, a sheep cell, a cow cell, a pig cell, a horse cell, a goat cell, a dog cell or a cat cell, or a population of mammalian cells. In one embodiment, the cell is a human cell.

In one embodiment, the cell, or population of cells, is manipulated ex vivo by altering a nucleic acid at one or more target positions, and administered to a subject. A cell, or population of cells, to be altered according to the methods disclosed herein, may include a stem cell such as, by way of example, an embryonic stem cell, an induced pluripotent stem cell or a neuronal stem cell, or a population of such cells. In one embodiment, the cell, or population of cells, is an induced pluripotent stem (iPS) cell or a cell derived from an iPS cell, or a population of such cells, altered to correct a mutation and differentiated into a clinically relevant cell, or population of cells.

In some embodiments, the cell is a cell from a disease-causing organism, e.g., a bacterium, fungus, protozoan, or parasite. In some embodiments, the cell is a cell infected with a disease-causing organism (e.g., a virus, fungus, protozoan, or parasite).

In some embodiments, the cell is situated in the body of a subject. In such instances, the cell might be the subject's own cells or might be a cell of a disease-causing organism. In this case, a gRNA molecule, a Cas9 molecule, and a nucleic acid template system, may be administered to the subject as pharmaceutical compositions. In some embodiments, the subject is a mammal, e.g., a human, a farm animal (e.g., a cow, a pig, a horse, or a goat), or a companion animal (e.g., a dog or a cat).

In some embodiments, the subject suffers from a disease caused by a target position in a nucleic acid, e.g., a particular mutation, of a cell, or population of cells.

In some embodiments, the cell, or population of cells, is a diseased or mutant-bearing cell, or population of cells. Such cells can be altered to treat the disease, e.g., to correct a mutation, or to alter the phenotype of the cell, or population of cells, e.g., to inhibit the growth of a cancer cell or a population of cancer cells, e.g., a tumor. For example, a cell, or a population of cells, is associated with one or more diseases or conditions describe herein. In some embodiments, the cell is a cancer stem cell. For example, cancer stem cells can be manipulated by modulating the expression of one or more genes selected from TWIST (TF), HIF-1 alpha, HER2/neu, Snail (TF), or Wnt. In some embodiments, the cancer cell is selected from lung cancer cells, breast cancer cells, skin cancer cells, brain cancer cells, pancreatic cancer cells, hematopoietic cancer cells, liver cancer cells, kidney cancer cells, and ovarian cancer cells.

In some embodiments, the cell is characterized by a disorder caused by aberrant mtDNA. This disorder may be, e.g., a mtDNA depletion syndrome (e.g., Alpers or early infantile hepatocerebral syndromes) or a mtDNA deletion disorder (e.g., progressive external ophthalmoplegia (PEO), ataxia-neuropathy, or mitochondrial neurogastrointestinal encephalomyopathy (MNGIE)).

In some embodiments, the cell, or population of cells, is a normal cell or a population of normal cells.

In some embodiments, the cell, or population of cells, is a stem cell or a progenitor cell (e.g., iPS, embryonic, hematopoietic, adipose, germline, lung, or neural stem or progenitor cells), or a population of such cells.

The cells may also be treated at a time when they are not situated in the body of a subject. In some embodiments, a cell, or a population of cells, is treated ex vivo to avoid exposing a patient to an agent or agents that cause undesirable side effects. In some embodiments, treating cells ex vivo allows a user to select a sub-population of cells to administer to the patient. The sub-population may be, e.g., cells having a nucleic acid that was successfully altered, or cells having a desired phenotype, such as minimal undesired alterations to DNA, or a phenotype that indicates the nucleic acid was successfully altered.

In some embodiments, the cell, or population of cells, is not situated in a subject's body and the cell, or population of cells, is modified for research or manufacturing purposes. In some embodiments, the cell, or population of cells, is suitable for producing a recombinant biological product. For example, the cell, or population of cells, can be a CHO cell or a fibroblast. In one embodiment, the cell, or population of cells, is a cell, or population of cells, that has been engineered to express a protein.

In some embodiments, the cell, or population of cells, is not actively dividing. In some embodiments, the cell is in in G0 phase (which is sometimes viewed as a prolonged G1 phase), is quiescent, or is senescent. In some embodiments, the population of cells are in G0 phase, are quiescent, or are senescent. In some embodiment, the quiescent cell can be a terminally differentiated cell. In some embodiments, the quiescent cell can be a neuron, a muscle cell, e.g., a cardiac muscle cell, a parenchymal cell e.g., a parenchymal liver or kidney cell, a hematopoietic cell e.g., a hematopoetic stem cell, a fibroblast, a stem cell e.g., an adult stem cell, a hepatic cell e.g., a hepatic stellate cell, an immune cell e.g., a T cell or B cell, or an epithelial cell. In some embodiments, the senescent cell may have shortened telomeres relative to an actively dividing cell, e.g., its telomeres may be of a length that triggers a halt in the cell cycle.

In some embodiments, the cell, or population of cells, is characterized by a disorder caused by aberrant mtDNA. This disorder may be, e.g., a mtDNA depletion syndrome (e.g., Alpers or early infantile hepatocerebral syndromes) or mtDNA deletion disorder (e.g., progressive external ophthalmoplegia (PEO), ataxia-neuropathy, or mitochondrial neurogastrointestinal encephalomyopathy (MNGIE)).

In some embodiments, the cell, or population of cells, is actively dividing. In some embodiments, the cell is in G2 phase. In some embodiments, the population of cells comprises cells that are in G2 phase. In some embodiments, the cell is in G1 phase. In some embodiments, the population of cells comprises cells that are in G1 phase. In some embodiments, the cell is in S phase. In some embodiments, the population of cells comprises cells that are in S phase.

The technology described herein can be used to edit numerous types of genomes, including plant genomes. The CRISPR/Cas system has been used for plant genome editing, as has been described in, e.g., Belhaj et al., PLANT METHODS 9:39, 2013. Plant cells can carry out HDR, so a Cas9-induced nick or DSB can be repaired by HDR. Plant cells also have NHEJ machinery, and in some embodiments, NHEJ is inhibited, resulting in stimulation of HDR. Accordingly, in certain embodiments, the cell, or the population of cells, is a plant cell, e.g., a monocot plant cell, or a dicot plant cell, or a population of plant cell. In certain embodiments, the plant is a crop, e.g., a food crop. In certain embodiments, the plant is rice (e.g., *Orzya sativa*), maize (e.g., *Zea mays*), wheat (e.g., *Triticum aestivum*), soy (e.g., *Glycine max*), potato (e.g., *Solanum tuberosum*), a species of *Nicotiana*, a species of *Arabidopsis* e.g., *Arabidopsis thaliana*, cassava, sweet potato, sorghum, yam, plantain, or a citrus plant. In some embodiments, the plant is a pesticide-resistant plant, e.g., a plant that expresses one or more genes that confer resistance to a pesticide. In some embodiments, the plant is herbicide-resistant plant, e.g., a plant that expresses one or more genes that confer resistance to a herbicide. The herbicide may be, e.g., Roundup® (also known as glyphosate or N-(phosphonomethyl)glycine). In some embodiments, the plant produces a pesticide, e.g., Bt.

In some embodiments, the components used in the methods described herein (e.g., a Cas9 molecule, a RMEM, a gRNA and/or a template nucleic acid) are introduced into the plant cell via protoplast transformation or agroinfiltration.

In some embodiments, after genome editing using the methods described herein, seeds are screened and a desired sub-population of seeds are selected. The sub-population may be, e.g., cells having a nucleic acid that was successfully altered, or cells having a desired phenotype such as minimal undesired alterations to DNA, or a phenotype that indicates the nucleic acid was successfully altered.

XI. Delivery, Formulations, and Routes of Administration

A RNA-guided nuclease molecule, e.g., a Cas9 molecule, and/or a RMEM, and, optionally, one or both of at least one gRNA molecule, and a template nucleic acid, can be delivered or formulated in a variety of forms, see, e.g., Tables 15-16. When an RNA-guided nuclease molecule and/or a RMEM or gRNA component is encoded as DNA for delivery, the DNA will typically but not necessarily include a control region, e.g., comprising a promoter, to effect expression. Useful promoters to drive the expression of nucleic acids encoding RNA-guided nuclease and/or RMEM sequences include CMV, EF-1a, MSCV, PGK, CAG control promoters. Useful promoters for gRNAs include H1, EF-1a and U6 promoters. Promoters with similar or dissimilar strengths can be selected to tune the expression of components. Sequences encoding a RNA-guided nuclease molecule and/or a RMEM can comprise a nuclear localization signal (NLS), e.g., an SV40 NLS. In one embodiment a promoter driving the expression of a RNA-guided nuclease molecule and/or a RMEM, or a gRNA molecule can be, independently, inducible, tissue specific, or cell specific.

Table 15 provides examples of the form in which the components can be delivered to a target cell.

TABLE 15

| Elements | | | | |
|---|---|---|---|---|
| RNA-guided nuclease molecule(s), e.g., Cas9 molecule(s) | RMEM(s) | gRNA molecule(s) | Donor Template Nucleic Acid | Comments |
| DNA | DNA | DNA | DNA | In one embodiment, a Cas9 molecule and a RMEM are produced (i.e., via transcription/translation) from DNA, and a gRNA molecule is transcribed from DNA. In this embodiment, they are encoded on separate DNA molecules, with the donor template provided as a separate DNA molecule. |
| | DNA | DNA | DNA | In one embodiment, a Cas9 molecule and a RMEM are produced (i.e., via transcription/translation) from DNA, and a gRNA molecule is transcribed from DNA. In this embodiment, a Cas9 molecule and a RMEM are encoded on the same DNA molecule. In this embodiment, the gRNA molecule is encoded by a separate DNA molecule. In this embodiment, the donor template is provided on a separate DNA molecule. |
| DNA | | DNA | DNA | In one embodiment, a Cas9 molecule and a RMEM are produced (i.e., via transcription/translation) from DNA, and a gRNA molecule is transcribed from DNA. In this embodiment, a Cas9 molecule and a gRNA molecule are encoded on the same DNA molecule. In this embodiment, the RMEM is encoded by a separate DNA molecule. In this embodiment, the donor template is provided on a separate DNA molecule. |
| DNA | DNA | | DNA | In one embodiment, a Cas9 molecule and a RMEM are produced (i.e., via transcription/translation) from DNA, and a gRNA molecule is transcribed from DNA. In this embodiment, a Cas9 molecule and a RMEM are encoded on separate molecules. In this embodiment, the donor template is provided on a separate DNA molecule that also encodes a gRNA molecule. |
| | DNA | | DNA | In one embodiment, a Cas9 molecule and a RMEM are produced (i.e., via transcription/translation) from DNA, and a gRNA molecule is transcribed from DNA. In this embodiment, a Cas9 molecule and a RMEM are encoded on the same DNA molecule. In this embodiment the donor template is provided on a separate DNA molecule that also encodes the gRNA molecule. |

TABLE 15-continued

| Elements | | | | |
|---|---|---|---|---|
| RNA-guided nuclease molecule(s), e.g., Cas9 molecule(s) | RMEM(s) | gRNA molecule(s) | Donor Template Nucleic Acid | Comments |
| DNA | | DNA | DNA | In one embodiment, a Cas9 molecule and a RMEM are produced (i.e., via transcription/translation) from DNA, and a gRNA molecule is transcribed from DNA. In this embodiment, a Cas9 molecule is encoded on the same DNA molecule that provides the donor template. In this embodiment, a RMEM is encoded on a separate DNA molecule that also encodes the gRNA molecule. |
| | DNA | | DNA | In one embodiment, a Cas9 molecule and a RMEM are produced (i.e., via transcription/translation) from DNA, and a gRNA molecule is transcribed from DNA, here from a single molecule. In this embodiment, the donor template is provided as a separate DNA molecule. |
| DNA | | DNA | | In one embodiment, a Cas9 molecule and a RMEM are produced (i.e., via transcription/translation) from DNA, and a gRNA molecule is transcribed from DNA. In this embodiment, a RMEM and a gRNA molecule are encoded by the same DNA molecule that also provides the donor template. In this embodiment, a Cas9 molecule is encoded on a separate DNA molecule. |
| | DNA | DNA | DNA | In one embodiment, a Cas9 molecule and a RMEM are produced (i.e., via transcription/translation) from DNA, and a gRNA molecule is transcribed from DNA. In this embodiment, a Cas9 molecule and a RMEM are encoded by the same DNA molecule that also provides the donor template. In this embodiment, a gRNA molecule is encoded on a separate DNA molecule. |
| DNA | DNA | DNA | | In one embodiment, a Cas9 molecule and a RMEM are produced (i.e., via transcription/translation) from DNA, and a gRNA molecule is transcribed from DNA. In this embodiment, a Cas9 molecule and a gRNA molecule are encoded by the same DNA molecule that also provides the donor template. In this embodiment, a RMEM is encoded on a separate DNA molecule. |
| | | DNA | | In one embodiment, a Cas9 molecule and a RMEM are produced (i.e., via transcription/translation) from DNA, and a gRNA molecule is transcribed from DNA, here from a single molecule. In this embodiment, the donor template is provided in the same DNA molecule that encodes the Cas9 molecule, the RMEM and a gRNA molecule. |

TABLE 15-continued

| RNA-guided nuclease molecule(s), e.g., Cas9 molecule(s) | RMEM(s) | gRNA molecule(s) | Donor Template Nucleic Acid | Comments |
|---|---|---|---|---|
| DNA | DNA | DNA | DNA | In one embodiment, a Cas9 molecule and a RMEM are produced (i.e., via transcription/translation) from DNA, and a gRNA molecule is transcribed from DNA. In this embodiment, they are encoded on separate DNA molecules. In this embodiment, the donor template is provided on the same DNA molecule that encodes the Cas9 molecule. |
| DNA | DNA | DNA | DNA | In one embodiment, a Cas9 molecule and a RMEM are produced (i.e., via transcription/translation) from DNA, and a gRNA molecule is transcribed from DNA. In this embodiment, they are encoded on separate DNA molecules. In this embodiment, the donor template is provided on the same DNA molecule that encodes the RMEM. |
| DNA | DNA | DNA | DNA | In one embodiment, a Cas9 molecule and a RMEM are produced (i.e., via transcription/translation) from DNA, and a gRNA molecule is transcribed from DNA. In this embodiment, a Cas9 molecule and a gRNA molecule are encoded on the same DNA molecule. In this embodiment, a RMEM is encoded by a separate DNA molecule. In this embodiment, the donor template is provided on a separate DNA molecule. |
| DNA | DNA | RNA | DNA | In one embodiment, a Cas9 molecule and a RMEM are produced (i.e., via transcription/translation) from DNA, and a gRNA molecule is provided as an in vitro transcribed or synthesized RNA. In this embodiment, a Cas9 molecule and a RMEM are encoded by separate DNA molecules. In this embodiment, the donor template is provided as a separate DNA molecule. |
| DNA | | RNA | DNA | In one embodiment, a Cas9 molecule and a RMEM are produced (i.e., via transcription/translation) from DNA, and a gRNA molecule is provided as an in vitro transcribed or synthesized RNA. In this embodiment, a Cas9 molecule and a RMEM are encoded by the same DNA molecule. In this embodiment, the donor template is provided as a separate DNA molecule. |
| DNA | | RNA | DNA | In one embodiment, a Cas9 molecule and a RMEM are produced (i.e., via transcription/translation) from DNA, and a gRNA molecule is provided as an in vitro transcribed or synthesized RNA. In this embodiment, a Cas9 molecule and a RMEM are encoded by the same DNA molecule that provides the donor template. |

TABLE 15-continued

| RNA-guided nuclease molecule(s), e.g., Cas9 molecule(s) | RMEM(s) | gRNA molecule(s) | Donor Template Nucleic Acid | Comments |
| --- | --- | --- | --- | --- |
| DNA | DNA | RNA | DNA | In one embodiment, a Cas9 molecule and a RMEM are produced (i.e., via transcription/translation) from DNA, and a gRNA molecule is provided as an in vitro transcribed or synthesized RNA. In this embodiment, the donor template is provided on the same DNA molecule that encodes a Cas9 molecule. In this embodiment, a RMEM is encoded by a separate DNA molecule. |
| DNA | DNA | RNA | DNA | In one embodiment, a Cas9 molecule and a RMEM are produced (i.e., via transcription/translation) from DNA, and a gRNA molecule is provided as an in vitro transcribed or synthesized RNA. In this embodiment, the donor template is provided on the same DNA molecule that encodes a RMEM. In this embodiment, a Cas9 molecule is encoded by a separate DNA molecule. |
| mRNA | DNA | RNA | DNA | In one embodiment, a Cas9 molecule is translated from an in vitro transcribed or synthesized mRNA, a RMEM is produced (i.e., via transcription/translation) from DNA, and a gRNA molecule is provided as an in vitro transcribed or synthesized RNA. In this embodiment, the DNA molecule that encodes a RMEM is provided as a separate molecule from the DNA molecule that provides the donor template. |
| mRNA | DNA | RNA | DNA | In one embodiment, a Cas9 molecule is translated from an in vitro transcribed or synthesized mRNA, a RMEM is produced (i.e., via transcription/translation) from DNA, and a gRNA molecule is provided as in vitro transcribed or synthesized RNA. In this embodiment, a RMEM is encoded by the same DNA molecule that also provides the donor template. |
| DNA | mRNA | RNA | DNA | In one embodiment, a RMEM is translated from an in vitro transcribed or synthesized mRNA, a Cas9 molecule is produced (i.e., via transcription/translation) from DNA, and a gRNA molecule is provided as in vitro transcribed or synthesized RNA. In this embodiment, the DNA molecule that encodes a Cas9 molecule is provided as a separate molecule from the DNA molecule that provides the donor template. |

TABLE 15-continued

| \multicolumn{5}{c}{Elements} | | | | |
|---|---|---|---|---|
| RNA-guided nuclease molecule(s), e.g., Cas9 molecule(s) | RMEM(s) | gRNA molecule(s) | Donor Template Nucleic Acid | Comments |
| DNA | mRNA | RNA | DNA | In one embodiment, a RMEM is translated from in vitro transcribed or synthesized mRNA, a Cas9 molecule is produced (i.e., via transcription/translation) from DNA, and a gRNA molecule is provided as in vitro transcribed or synthesized RNA. In this embodiment, a Cas9 molecule is encoded by the same DNA molecule that provides the donor template. |
| mRNA | mRNA | RNA | DNA | In one embodiment, a RMEM is translated from in vitro transcribed or synthesized mRNA, a Cas9 molecule is translated from in vitro transcribed or synthesized mRNA, and a gRNA molecule is provided as in vitro transcribed or synthesized RNA. In this embodiment, the donor template is provided as a DNA molecule. |
| DNA | mRNA | DNA | DNA | In one embodiment, a RMEM is translated from in vitro transcribed or synthesized mRNA, a Cas9 molecule is produced (i.e., via transcription/translation) from DNA, and a gRNA molecule is transcribed from DNA. In this embodiment, a Cas9 and a gRNA molecule are encoded by separate DNA molecules. In this embodiment, the donor template is provided as a DNA molecule. |
| DNA | mRNA | DNA | DNA | In one embodiment, a RMEM is translated from in vitro transcribed or synthesized mRNA, a Cas9 molecule is produced (i.e., via transcription/translation) from DNA, and a gRNA molecule is transcribed from DNA. In this embodiment, a Cas9 and a gRNA molecule are encoded by the same DNA molecule. In this embodiment, the donor template is provided as a separate DNA molecule. |
| DNA | mRNA | | DNA | In one embodiment, a RMEM is translated from in vitro transcribed or synthesized mRNA, a Cas9 molecule is produced (i.e., via transcription/translation) from DNA, and a gRNA molecule is transcribed from DNA. In this embodiment, a gRNA molecule is encoded by the same DNA molecule that provides the donor template. In this embodiment, a Cas9 molecule is encoded by a separate DNA molecule. |
| DNA | mRNA | DNA | DNA | In one embodiment, a RMEM is translated from in vitro transcribed or synthesized mRNA, a Cas9 molecule is produced (i.e., via transcription/translation) from DNA, and a gRNA molecule is transcribed from DNA. In this embodiment, a Cas9 molecule is encoded by the same DNA molecule that provides the donor template. In this embodiment, a gRNA molecule is encoded by a separate DNA molecule. |

TABLE 15-continued

| | | Elements | | |
|---|---|---|---|---|
| RNA-guided nuclease molecule(s), e.g., Cas9 molecule(s) | RMEM(s) | gRNA molecule(s) | Donor Template Nucleic Acid | Comments |
| DNA | mRNA | DNA | | In one embodiment, a RMEM is translated from in vitro transcribed or synthesized mRNA, a Cas9 molecule is produced (i.e., via transcription/translation) from DNA, and a gRNA molecule is transcribed from DNA. In this embodiment, a Cas9 molecule and a gRNA molecule are encoded by the same DNA molecule that provides the donor template. |
| mRNA | DNA | DNA | DNA | In one embodiment, a Cas9 molecule is translated from in vitro transcribed or synthesized mRNA, and a RMEM is produced (i.e., via transcription/translation) from DNA, and a gRNA molecule is transcribed from DNA. In this embodiment, a RMEM and a gRNA molecule are encoded by separate DNA molecules. In this embodiment, the donor template is provided as a separate DNA molecule. |
| mRNA | DNA | DNA | DNA | In one embodiment, a Cas9 molecule is translated from in vitro transcribed or synthesized mRNA, a RMEM is produced (i.e., via transcription/translation) from DNA, and a gRNA molecule is transcribed from DNA. In this embodiment, a RMEM and a gRNA molecule are encoded by the same DNA molecule. In this embodiment, the donor template is provided as a separate DNA molecule. |
| mRNA | DNA | DNA | | In one embodiment, a Cas9 molecule is translated from in vitro transcribed or synthesized mRNA, a RMEM is produced (i.e., via transcription/translation) from DNA, and a gRNA molecule is transcribed from DNA. In this embodiment, a gRNA molecule is encoded by the same DNA molecule that provides the donor template. In this embodiment, a RMEM is encoded by a separate DNA molecule. |
| mRNA | DNA | DNA | DNA | In one embodiment, a Cas9 molecule is translated from in vitro transcribed or synthesized mRNA, a RMEM is produced (i.e., via transcription/translation) from DNA, and a gRNA molecule is transcribed from DNA. In this embodiment, a RMEM is encoded by the same DNA molecule that provides the donor template. In this embodiment, a gRNA molecule is encoded by a separate DNA molecule. |
| mRNA | | DNA | | In one embodiment, a Cas9 molecule is translated from in vitro transcribed or synthesized mRNA, a RMEM is produced (i.e., via transcription/translation) from DNA, and a gRNA molecule is transcribed from DNA. In this embodiment, a RMEM and a gRNA molecule are encoded by the same DNA molecule that provides the donor template. |

TABLE 15-continued

| Elements | | | | |
|---|---|---|---|---|
| RNA-guided nuclease molecule(s), e.g., Cas9 molecule(s) | RMEM(s) | gRNA molecule(s) | Donor Template Nucleic Acid | Comments |
| mRNA | mRNA | DNA | DNA | In one embodiment, a RMEM is translated from in vitro transcribed or synthesized mRNA, a Cas9 molecule is translated from in vitro transcribed or synthesized mRNA, and a gRNA molecule is transcribed from DNA. In this embodiment, a gRNA molecule is encoded by a DNA molecule that is separate from the DNA molecule that provides the donor template. |
| mRNA | mRNA | DNA | | In one embodiment, a RMEM is translated from in vitro transcribed or synthesized mRNA, a Cas9 molecule is translated from in vitro transcribed or synthesized mRNA, and a gRNA molecule is transcribed from DNA. In this embodiment, a gRNA molecule is encoded by the same DNA molecule that provides the donor template. |
| Protein | DNA | RNA | DNA | In one embodiment, a Cas9 molecule is provided as a protein, a RMEM is produced (i.e., via transcription/translation) from DNA, and a gRNA molecule is provided as in vitro transcribed or synthesized RNA. In this embodiment, the donor template is provided as a separate DNA molecule from the DNA molecule that encodes a RMEM. |
| Protein | DNA | RNA | DNA | In one embodiment, a Cas9 molecule is provided as a protein, a RMEM is produced (i.e., via transcription/translation) from DNA, and a gRNA molecule is provided as in vitro transcribed or synthesized RNA. In this embodiment, a RMEM is encoded by a DNA molecule that also provides the donor template. |
| DNA | Protein | RNA | DNA | In one embodiment, a RMEM is provided as a protein, a Cas9 molecule is produced (i.e., via transcription/translation) from DNA, and a gRNA molecule is provided as in vitro transcribed or synthesized RNA. In this embodiment, the DNA molecule that encodes a Cas9 molecule is separate from the DNA the provides the donor template. |
| DNA | Protein | RNA | DNA | In one embodiment, a RMEM is provided as a protein, a Cas9 molecule is produced (i.e., via transcription/translation) from DNA, and a gRNA molecule is provided as in vitro transcribed or synthesized RNA. In this embodiment, a Cas9 molecule is encoded by a DNA molecule that also provides the donor template. |
| Protein | Protein | RNA | DNA | In one embodiment, a RMEM and a Cas9 molecule are provided as proteins, and a gRNA molecule is provided as in vitro transcribed or synthesized RNA. In this embodiment, the donor template is provided as a DNA molecule. |

TABLE 15-continued

| RNA-guided nuclease molecule(s), e.g., Cas9 molecule(s) | RMEM(s) | gRNA molecule(s) | Donor Template Nucleic Acid | Comments |
|---|---|---|---|---|
| DNA | Protein | DNA | DNA | In one embodiment, a RMEM is provided as a protein, a Cas9 molecule is produced (i.e., via transcription/translation) from DNA, and a gRNA molecule is transcribed from DNA. In this embodiment, a Cas9 and a gRNA molecule are encoded by separate DNA molecules. In this embodiment, the donor template is provided as a separate DNA molecule. |
| DNA | Protein | DNA | DNA | In one embodiment, a RMEM is provided as a protein, a Cas9 molecule is produced (i.e., via transcription/translation) from DNA, and a gRNA molecule is transcribed from DNA. In this embodiment, a Cas9 molecule and a gRNA molecule are encoded by the same DNA molecule. In this embodiment, the donor template is provided as a separate DNA molecule. |
| DNA | Protein | DNA | | In one embodiment, a RMEM is provided as a protein, a Cas9 molecule is produced (i.e., via transcription/translation) from DNA, and a gRNA molecule is transcribed from DNA. In this embodiment, a gRNA molecule is encoded by the same DNA molecule that provides the donor template. In this embodiment, a Cas9 molecule is encoded by a separate DNA molecule. |
| DNA | Protein | DNA | DNA | In one embodiment, a RMEM is provided as a protein, a Cas9 molecule is produced (i.e., via transcription/translation) from DNA, and a gRNA molecule is transcribed from DNA. In this embodiment, a Cas9 molecule is encoded by the same DNA molecule that provides the donor template. In this embodiment, a gRNA molecule is encoded by a separate DNA molecule. |
| DNA | Protein | DNA | | In one embodiment, a RMEM is provided as a protein, a Cas9 molecule is produced (i.e., via transcription/translation) from DNA, and a gRNA molecule is transcribed from DNA. In this embodiment, a Cas9 molecule and a gRNA molecule are encoded by the same DNA molecule that provides the donor template. |
| Protein | DNA | DNA | DNA | In one embodiment, a Cas9 molecule is provided as a protein, a RMEM is produced (i.e., via transcription/translation) from DNA, and a gRNA molecule is transcribed from DNA. In this embodiment, a RMEM and a gRNA molecule are encoded by separate DNA molecules. In this embodiment, the donor template is provided as a separate DNA molecule. |

TABLE 15-continued

| | | Elements | | |
|---|---|---|---|---|
| RNA-guided nuclease molecule(s), e.g., Cas9 molecule(s) | RMEM(s) | gRNA molecule(s) | Donor Template Nucleic Acid | Comments |
| Protein | DNA | DNA | DNA | In one embodiment, a Cas9 molecule is provided as a protein, a RMEM is produced (i.e., via transcription/translation) from DNA, and a gRNA molecule is transcribed from DNA. In this embodiment, a RMEM and a gRNA molecule are encoded by the same DNA molecule. In this embodiment, the donor template is provided as a separate DNA molecule. |
| Protein | DNA | DNA | | In one embodiment, a Cas9 molecule is provided as a protein, a RMEM is produced (i.e., via transcription/translation) from DNA, and a gRNA molecule is transcribed from DNA. In this embodiment, a gRNA molecule is encoded by the same DNA molecule that provides the donor template. In this embodiment, a RMEM is encoded by a separate DNA molecule. |
| Protein | DNA | DNA | DNA | In one embodiment, a Cas9 molecule is provided as a protein, a RMEM is produced (i.e., via transcription/translation) from DNA, and a gRNA molecule is transcribed from DNA. In this embodiment, a RMEM is encoded by the same DNA molecule that provides the donor template. In this embodiment, a gRNA molecule is encoded by a separate DNA molecule. |
| Protein | | DNA | | In one embodiment, a Cas9 molecule is provided as a protein, a RMEM is produced (i.e., via transcription/translation) from DNA, and a gRNA molecule is transcribed from DNA. In this embodiment, a RMEM and a gRNA molecule are encoded by the same DNA molecule that provides the donor template. |
| Protein | Protein | DNA | DNA | In one embodiment, a RMEM and a Cas9 molecule are provided as proteins, and a gRNA molecule is transcribed from DNA. In this embodiment, a gRNA molecule is encoded by a DNA molecule that is separate from the DNA molecule that provides the donor template. |
| Protein | Protein | DNA | | In one embodiment, a RMEM and a Cas9 molecule are provided as proteins, and a gRNA molecule is transcribed from DNA. In this embodiment, a gRNA molecule is encoded by the same DNA molecule that provides the donor template. |

Table 16 summarizes various delivery methods for the components of a system of the disclosure, e.g., the RNA-guided nuclease molecule and/or the RMEM component(s) and the gRNA molecule component, as described herein.

TABLE 16

| | Delivery Vector/Mode | Delivery into Non-Dividing Cells | Duration of Expression | Genome Integration | Type of Molecule Delivered |
|---|---|---|---|---|---|
| Physical (e.g., electroporation, particle gun, calcium phosphate transfection) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of an RNA-Guided Nuclease Molecule and/or a RMEM and/or a gRNA Molecule DNA encoding RNA-guided nuclease molecule(s) (e.g., Cas9 molecules) and/or RMEM, gRNA molecule(s), and/or template nucleic acids can be administered to subjects or delivered into cells by any appropriate method, e.g., by art-known methods or as described herein. For example, Cas9-encoding, RMEM-encoding and/or gRNA-encoding DNA, and a template nucleic acid can be delivered, e.g., by vectors (e.g., viral or non-viral vectors), non-vector based methods (e.g., using naked DNA or DNA complexes), or a combination thereof.

In some embodiments, the nucleic acid, e.g., Cas9-encoding and/or RMEM-encoding and/or gRNA-encoding DNA is delivered by a vector (e.g., viral vector/virus or plasmid).

In one embodiment, a vector can comprise a sequence that encodes a Cas9 molecule, a RMEM, and a gRNA molecule. A vector can also comprise a nucleic acid encoding a signal peptide (e.g., for nuclear localization, nucleolar localization, mitochondrial localization), fused, e.g., to a nucleic acid encoding Cas9 molecule and/or a RMEM. For example, a vector can comprise a nucleic acid encoding a nuclear localization sequence (e.g., from SV40) fused to the nucleic acid encoding the Cas9 molecule. A vector can also comprise a nucleic acid encoding a nuclear localization sequence (e.g., from SV40) fused to the nucleic acid encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter).

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In other embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the RMEM and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the RMEM and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In some embodiments, the Cas9-, RMEM-, gRNA-, and/or template binding domain-encoding DNA is delivered by a recombinant adenovirus. In some embodiments, the adenovirus is engineered to have reduced immunity in human.

In some embodiments, Cas9-, RMEM-, and/or gRNA-encoding DNA is delivered by a recombinant AAV. In some embodiments, the AAV can incorporate its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudotyped AAV, such as AAV2/8, AAV2/5 and AAV2/6 can also be used in the disclosed methods.

In some embodiments, the Cas9-, and/or RMEM-, and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the delivery vehicle is a non-viral vector. In some embodiments, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In one embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 17.

TABLE 17

| Lipids Used for Gene Transfer | | |
|---|---|---|
| Lipid | Abbreviation | Feature |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 18

TABLE 18

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In some embodiments, the vehicle has targeting modifications to increase target cell update of nanoparticles and liposomes, e.g., cell specific antigens, monoclonal antibodies, single chain antibodies, aptamers, polymers, sugars, and cell penetrating peptides. In some embodiments, the vehicle uses fusogenic and endosome-destabilizing peptides/polymers. In some embodiments, the vehicle undergoes acid-triggered conformational changes (e.g., to accelerate endosomal escape of the cargo). In some embodiments, a stimuli-cleavable polymer is used, e.g., for release in a cellular compartment. For example, disulfide-based cationic polymers that are cleaved in the reducing cellular environment can be used.

In one embodiment, the delivery vehicle is a biological non-viral delivery vehicle.

In some embodiments, one or more nucleic acid molecules (e.g., a DNA molecule or a template nucleic acid) other than the components of a Cas system described herein, e.g., the Cas9 molecule component, and/or the RMEM component, and/or the gRNA molecule component described herein, are delivered. In one embodiment, the nucleic acid molecule is delivered at the same time as one or more of the components of the Cas system are delivered. In one embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In one embodiment, the nucleic acid molecule is delivered by a different means than one or more of the components of the Cas system, e.g., the Cas9 molecule component, and/or the RMEM component, and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component, and/or RMEM component, and/or the gRNA molecule component can be delivered by electroporation, e.g., such that the toxicity caused by nucleic acids (e.g., DNAs) can be reduced. In one embodiment, the nucleic acid molecule encodes a protein, e.g., a Cas9 molecule or a RMEM, as described herein. In one embodiment, the nucleic acid molecule encodes an RNA molecule, e.g., an RNA molecule described herein. In some embodiments, the nucleic acid is a template nucleic acid capable of participating in HDR.

Delivery of RNA Encoding a RNA-Guided Nuclease Molecule and/or a RMEM

RNA encoding RNA-guided nuclease molecule(s) (e.g., comprising a eaCas9 molecule), RMEM(s), and/or gRNA molecules, can be delivered into cells, e.g., target cells described herein, by any appropriate method, including art-known methods or methods described herein. For example, Cas9-encoding and/or RMEM-encoding RNA can be delivered, e.g., by microinjection, electroporation, lipid-mediated transfection, peptide-mediated delivery, or a combination thereof. Delivery can be accompanied by DNA encoding a gRNA or by a gRNA. Delivery can also be accompanied by a donor template nucleic acid.

Delivery of RNA-Guided Nuclease and/or RMEM Protein

RNA-guided nuclease molecules and/or RMEMs can be delivered into cells by any appropriate method, including art-known methods or methods described herein. For example, the protein molecules can be delivered, e.g., by microinjection, electroporation, lipid-mediated transfection, peptide-mediated delivery, or a combination thereof. See also Example 4, below. Delivery can be accompanied by DNA encoding a gRNA or by a gRNA. Delivery can also be accompanied by a donor template nucleic acid.

Route of Administration

Systemic modes of administration include oral and parenteral routes. Parenteral routes include, by way of example, intravenous, intraarterial, intraosseous, intramuscular, intradermal, subcutaneous, intranasal and intraperitoneal routes. Components administered systemically may be modified or formulated to target the components to the desired cell type.

Local modes of administration include, by way of example, intrathecal, intracerebroventricular, intraparenchymal (e.g., localized intraparenchymal delivery to the striatum (e.g., into the caudate or into the putamen)), cerebral cortex, precentral gyrus, hippocampus (e.g., into the dentate gyrus or CA3 region), temporal cortex, amygdala, frontal cortex, thalamus, cerebellum, medulla, hypothalamus, tectum, tegmentum or substantia nigra intraocular, intraorbital, subconjuctival, intravitreal, subretinal or transscleral routes. In one embodiment, significantly smaller amounts of the components (compared with systemic approaches) may exert an effect when administered locally (for example, intraparenchymal or intravitreal) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus or as continuous infusion from an internal reservoir or from an external reservoir (for example, from an intravenous bag).

Components may be administered locally, for example, by continuous release from a sustained release drug delivery device.

Bi-Modal or Differential Delivery of Components

Separate delivery of the components, e.g., the RNA-guided nuclease molecule component, the RMEM component, the gRNA molecule component, and/or the template nucleic acid, and more particularly, delivery of the components by differing modes, can enhance performance, e.g., by improving tissue specificity and safety.

In one embodiment, one or more of the RNA-guided nuclease molecule, the RMEM, the gRNA molecule, and/or the template nucleic acid, are delivered by different modes, or as sometimes referred to herein as differential modes. Different or differential modes, as used herein, refer to modes of delivery that confer different pharmacodynamic or pharmacokinetic properties on the subject component molecule, e.g., a RNA-guided nuclease molecule, and/or a RMEM, and/or a gRNA molecule and/or template nucleic acid. For example, the modes of delivery can result in different tissue distribution, different half-life, or different temporal distribution, e.g., in a selected compartment, tissue, or organ. In many embodiments, the components are delivered so that one or more of, e.g., all of, a RNA-guided nuclease molecule, a RMEM, a gRNA molecule, and template nucleic acid will be present in the same cell at the same time.

In some embodiments, two gRNAs are delivered to a cell so that a first nickase will make a first single strand break and a second nickase will make a second single strand break. In such embodiments, the two gRNAs and other components (e.g., the RNA-guided nuclease molecule) are delivered such that the two breaks are made at substantially the same time. In some embodiments, this comprises the second break being formed before the first break engages with machinery specific to the SSBR (single strand break repair) pathway, and in some embodiments, it comprises the second break being formed before the first break is repaired. More generally, when one desires to make two or more breaks in a target nucleic acid, the gRNAs and other components can be delivered such that the two or more breaks are made at substantially the same time.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a RNA-guided nuclease molecule, a RMEM, a gRNA molecule, and template nucleic acid can be delivered by modes that differ in terms of resulting half-life or persistent of the delivered component the body, or in a particular compartment, tissue or organ. In one embodiment, one or both of, e.g., all of, a gRNA molecule and a template nucleic acid can be delivered by such modes. The RNA-guided nuclease molecule and/or the RMEM components can be delivered by a mode which results in less persistence or less exposure to the body or a particular compartment or tissue or organ.

More generally, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In one embodiment, the first pharmacodynamic or pharmacokinetic property, e.g., distribution, persistence or exposure, is more limited than the second pharmacodynamic or pharmacokinetic property.

In one embodiment, the first mode of delivery is selected to optimize, e.g., minimize, a pharmacodynamic or pharmacokinetic property, e.g., distribution, persistence or exposure.

In one embodiment, the second mode of delivery is selected to optimize, e.g., maximize, a pharmacodynamic or pharmacokinetic property, e.g., distribution, persistence or exposure.

In one embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In one embodiment, the second mode of delivery comprises a relatively transient element, e.g., an RNA or protein.

In one embodiment, the first component comprises a gRNA or template nucleic acid and the delivery mode is relatively persistent, e.g., the gRNA is transcribed from a plasmid or viral vector, e.g., an AAV or lentivirus. Transcription of these genes would be of little physiological consequence because the genes generally do not encode for a protein product, and the gRNAs are incapable of acting in isolation. The second component, a RNA-guided nuclease molecule in combination with a RMEM, is delivered in a transient manner, for example as mRNA or as protein, ensuring that the all components are present and active for a short period of time.

Furthermore, the components can be delivered in different molecular form or with different delivery vectors that complement one another to enhance safety and tissue specificity.

Use of differential delivery modes can enhance performance, safety and efficacy. For example, the likelihood of an eventual off-target modification can be reduced. Delivery of immunogenic components, e.g., a RNA-guided nuclease molecule and/or a RMEM, by less persistent modes can reduce immunogenicity, as peptides from e.g., bacteria-derived proteins, e.g., a bacteria-derived Cas9 molecule or from a bacteria-derived RMEM, are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, In one embodiment, a first component, e.g., a gRNA molecule is delivered by a first delivery mode that results in a first spatial, e.g., tissue, distribution. A second component, e.g., a RNA-guided nuclease molecule in combination with a RMEM, is delivered by a second delivery mode that results in a second spatial, e.g., tissue, distribution.

In one embodiment, the first mode comprises a first element selected from a liposome, nanoparticle, e.g., polymeric nanoparticle, and a nucleic acid, e.g., viral vector. The second mode comprises a second element selected from the group. In one embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When a RNA-guided nuclease molecule and/or a RMEM are delivered via a virus delivery vector, a liposome, or polymeric nanoparticle, there is the potential for delivery to, and therapeutic activity in, multiple tissues, when it may be desirable to only target a single tissue. A two-part delivery system can resolve this challenge and enhance tissue specificity.

If the gRNA molecule and the RNA-guided nuclease molecule/RMEM (e.g., nucleic acids encoding a Cas9 molecule and a RMEM, or e.g., Cas9 and RMEM polypeptides) are packaged in separated delivery vehicles with distinct but overlapping tissue tropism, the fully functional complex is only formed in the tissue that is targeted by both vectors.

Ex Vivo Delivery In some embodiments, components described in Table 14 are introduced into cells which are then introduced into the subject. Methods of introducing the components can include, e.g., any of the delivery methods described in Table 15.

In some embodiments, the cells are contacted with a RNA-guided nuclease molecule in combination with a RMEM (or nucleic acid(s) encoding them) ex vivo. In one embodiment, the cells are contacted with a gRNA (or a nucleic acid encoding it) ex vivo. In some embodiment, the cells are contacted with a template nucleic acid ex vivo. In one embodiment, the cells are contacted with two, three, or all four of the preceding compositions (or nucleic acids encoding them) ex vivo. In one embodiment, the cells are contacted with one or more of the preceding components (or nucleic acids encoding them), and one or more remaining components are administered to the patient.

XII. Modified Nucleosides, Nucleotides, and Nucleic Acids

Modified nucleosides and modified nucleotides can be present in nucleic acids, e.g., particularly gRNA, and/or a template nucleic acid, but also other forms of DNA or RNA, e.g., mRNA. As described herein, "nucleoside" is defined as a compound containing a five-carbon sugar molecule (a pentose such as deoxyribose or ribose) or derivative thereof, and an organic base (purine or pyrimidine, or a derivative thereof). As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose or deoxyribose sugar, e.g., of the 2' hydroxyl on the sugar;

(iii) wholesale replacement of the phosphate moiety with "dephospho" linkers;

(iv) modification or replacement of a naturally occurring nucleobase;

(v) replacement or modification of the ribose- or deoxyribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In one embodiment, every base of a gRNA, or template nucleic acid is modified, e.g., all bases have a modified phosphate group, e.g., all are phosphorothioate groups. In some embodiments, all, or substantially all, of the phosphate groups of a unimolecular or modular gRNA molecule, or template nucleic acid are replaced with phosphorothioate groups.

In one embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

In some embodiments, a template nucleic acid comprises modifications, e.g., modified nucleotides, modifications to the backbone, and other modifications described herein. In some embodiments, the modification improves the stability of the template nucleic acid, e.g., by increasing its resistance to endonucleases and/or exonucleases.

In some embodiments, a template nucleic acid that comprises modifications is double stranded, e.g., is double stranded DNA. In some such embodiments, all the modifications are confined to one strand. In other embodiments, modifications are present on both strands. Modifications may be present in the 5' homology arm, the 3' homology arm, or the replacement sequence, or any combination thereof. In some embodiments, modifications are present in one or both homology arms but not the replacement sequence.

In some embodiments, a template nucleic acid that comprises modifications is single stranded, e.g., is single stranded DNA.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide (or oligodeoxyribonucleotide) diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates.

In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), (OCH2CH2OCH3, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), -NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, and DNA includes the sugar group deoxyribose, each of which is a 5-membered ring having an oxygen. Exemplary modified nucleosides and modified nucleotides can include, without limitation, replacement of the oxygen in the ribose or deoxyribose ring (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'-2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (y), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s2U$), 5-aminomethyl-2-thio-uridine ($nm^5s2U$), 5-methylaminomethyl-uridine ($mnm^5U$), 5-methylaminomethyl-2-thio-uridine ($mnm^5s2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s2U$), 5-propynyl-uridine, 1-propynyl-pseudouridine, 5-taurinomethyl-uridine (zcmU), 1-taurinomethyl-pseudouridine, 5-taurinomethyl-2-thio-uridine($zm^5s2U$), 1-taurinomethyl-4-thio-pseudouridine, 5-methyl-uridine ($m^5U$, i.e., having the nucleobase deoxythymine), 1-methyl-pseudouridine ($m^1\psi$), 5-methyl-2-thio-uridine ($m^5s2U$), 1-methyl-4-thio-pseudouridine ($m^1s^4\psi$), 4-thio-1-methyl-pseudouridine, 3-methyl-pseudouridine ($m^3 y$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine ($acp^3U$), 1-methyl-3-(3-amino-3-carboxypropyl) pseudouridine ($acp^3\psi$), 5-(isopentenylaminomethyl)uridine ($inm^5U$), 5-(isopentenylaminomethyl)-2-thio-uridine ($inm^5s2U$), a-thio-uridine, 2'-O-methyl-uridine (Um), 5,2'-O-dimethyl-uridine ($m^5Um$), 2'-O-methyl-pseudouridine (Wm), 2-thio-2'-O-methyl-uridine (s2Um), 5-methoxycarbonylmethyl-2'-O-methyl-uridine ($mcm^5Um$), 5-carbamoylmethyl-2'-O-methyl-uridine ($ncm^5Um$), 5-carboxymethylaminomethyl-2'-O-methyl-uridine ($cmnm^5Um$), 3,2'-O-dimethyl-uridine ($mn^3Um$), 5-(isopentenylaminomethyl)-2'-O-methyl-uridine ($inm^5Um$), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Thymine

In some embodiments, the modified nucleobase is a modified thymine. Thymine differs from uracil in that thymine has a methyl group on carbon 5 of the 6-carbon ring, while uracil has a hydrogen in that position. In some embodiments, the modified thymine is derived from one of the modified uracils described in the previous paragraph, but having said methyl group instead of a hydrogen.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (mn$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), a-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-O-methyl-cytidine (f$^5$Cm), N4,N4,2'-O-trimethyl-cytidine (m$^4{}_2$Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenine (m$^2$A), N6-methyl-adeno sine (m$^6$A), 2-methylthio-N6-methyl-adeno sine (ms$^2$ m$^6$A), N6-isopentenyl-adenosine (i$^6$A), 2-methylthio-N6-isopentenyl-adenosine (ms$^2$i$^6$A), N6-(cis-hydroxyisopentenyl)adeno sine (io$^6$A), 2-methylthio-N6-(cis-hydroxyisopentenyl)adeno sine (ms$^2$io$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t6A), 2-methylthio-N6-threonylcarbamoyl-adenosine (ms$^2$g$^6$A), N6,N6-dimethyl-adenosine (m$^{62}$A), N6-hydroxynorvalylcarbamoyl-adenosine (hn$^6$A), 2-methylthio-N6-hydroxynorvalylcarbamoyl-adenosine (ms$^2$hn$^6$A), N6-acetyl-adenosine (ac$^6$A), 7-methyl-adenine, 2-methylthio-adenine, 2-methoxy-adenine, α-thio-adenosine, 2'-O-methyl-adenosine (Am), N$^6$,2'-O-dimethyl-adenosine (m$^6$Am), N$^6$-Methyl-2'-deoxyadenosine, N6,N6,2'-O-trimethyl-adenosine (m$^6{}_2$Am), 1,2'-O-dimethyl-adenosine (m$^1$Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m$^1$I), wyosine (imG), methyl-wyosine (mimG), 4-demethyl-wyosine (imG-14), isowyosine (imG2), wybutosine (yW), peroxywybutosine (o$_2$yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQo), 7-aminomethyl-7-deaza-guanosine (preQi), archaeosine (G+), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m$^7$G), N2-methyl-guanosine (m$^2$G), N2,N2-dimethyl-guanosine (m$^2{}_2$G), N2,7-dimethyl-guanosine (m$^2$,7G), N2, N2,7-dimethyl-guanosine (m$^2$,2,7G), 8-oxo-guanosine, 7-methyl-8-oxo-guanosine, 1-meth thio-guanosine, N2-methyl-6-thio-guanosine, N2,N2-dimethyl-6-thio-guanosine, c-thio-guanosine, 2'-O-methyl-guanosine (Gm), N2-methyl-2'-O-methyl-guanosine (m$^2$Gm), N2,N2-dimethyl-2'-O-methyl-guanosine (m$^2{}_2$Gm), 1-methyl-2'-O-methyl-guanosine (m'Gm), N2,7-dimethyl-2'-O-methyl-guanosine (m$^2$,7Gm), 2'-O-methyl-inosine (Im), 1,2'-O-dimethyl-inosine (m'Im), O$^6$-phenyl-2'-deoxyinosine, 2'-O-ribosylguanosine (phosphate) (Gr(p)), 1-thio-guanosine, O$^6$-methyl-guanosine, O$^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as shown below:

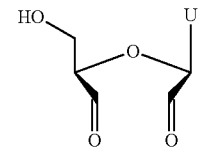

wherein "U" can be an unmodified or modified uridine.

In another embodiment, the 3' terminal U can be modified with a 2'3' cyclic phosphate as shown below:

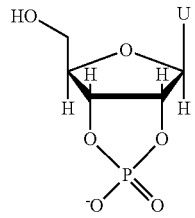

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl andenosine, can be incorporated into the gRNA. In some embodiments, sugar-modified ribonucleotides can be incorporated, e.g., wherein the 2' OH-group is replaced by a group selected from H, —OR, -R (wherein R can be, e.g., alkyl, cycloalkyl, aryl, aralkyl, heteroaryl or sugar), halo, —SH, -SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m$^5$Ceo), and any combinations thereof.

In one embodiment, one or more or all of the nucleotides in single stranded RNA molecule, e.g., a gRNA molecule, are deoxynucleotides.

In another aspect, methods and compositions discussed herein provide methods and compositions for genome editing by using a gRNA molecule which comprises a polyA tail. In one embodiment, a polyA tail of undefined length ranging from 1 to 1000 nucleotide(s) is added enzymatically using a polymerase such as E. coli polyA polymerase (E-PAP). In one embodiment, the polyA tail of a specified length (e.g., 1, 5, 10, 20, 30, 40, 50, 60, 100, or 150 nucleotides) is encoded on a DNA template and transcribed with the gRNA via an RNA polymerase (e.g., T7 RNA polymerase). In one embodiment, a polyA tail of defined length (e.g., 1, 5, 10, 20, 30, 40, 50, 60, 100, or 150 nucleotides) is synthesized as a synthetic oligonucleotide and ligated on the 3' end of the gRNA with either an RNA ligase or a DNA ligase with our without a splinted DNA oligonucleotide complementary to the guide RNA and the polyA oligonucleotide. In one embodiment, the entire gRNA including a defined length of polyA tail is made synthetically, in one or several pieces, if made in more than one piece, and ligated together by either an RNA ligase or a DNA ligase with or without a splinted oligonucleotide.

Modified Template Nucleic Acids

In some embodiments, the template nucleic acid comprises chemical modifications.

These modifications may, e.g., increase the stability or half-life of the nucleic acid or reduce the innate immune response to the nucleic acid.

In one embodiment, the template nucleic acid can be modified at one or two 3' ends. In this embodiment, the template nucleic acid can be modified at the 3' nucleotide. For example, the two terminal hydroxyl groups of the 3'-most sugar can be oxidized to aldehyde groups and a concomitant opening of the ring to afford a modified nucleoside, analogous to the first ribonucleotide shown in the previous section entitled "Modified gRNAs".

In another embodiment, the 3' terminal sugar can be modified with a 2'3' cyclic phosphate, analogous to the second ribonucleotide shown in the previous section entitled "Modified gRNAs".

In some embodiments, the template nucleic acid may contain 3' nucleotides which can be stabilized against degradation, e.g., by incorporating one or more of the modified nucleotides described herein. In this embodiment, e.g., thymines can be replaced with any of the modified thymines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the template nucleic acid. In some embodiments, O- and N-alkylated nucleotides, e.g., N6-methyl andenosine, can be incorporated into the nucleic acid template system. In some embodiments, sugar-modified deoxyribonucleotides can be incorporated, e.g., wherein the 2' H-group is replaced by a group selected from OH, —OR, -R (wherein R can be, e.g., alkyl, cycloalkyl, aryl, aralkyl, heteroaryl or sugar), halo, —SH, -SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In one embodiment, the phosphate backbone can be modified as described herein, e.g., with a phosphothioate group. In some embodiments, the template nucleic acid comprises an overhang region, and the nucleotides in the overhang region can each independently be a modified or unmodified nucleotide including, but not limited to 2'-sugar modified, such as, 2-F 2'-O-methyl, 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, the template nucleic acid is nicked, e.g., at the same position as a nick or DSB on target nucleic acid. In some embodiments, a nick on a double stranded template nucleic acid stimulates HDR. In some embodiments, one or more nicks on the template nucleic acid are on the strand that is complementary to the intact target strand; in embodiments, one or more nicks on the template nucleic acid are on the strand that is complementary to the nicked target stand.

miRNA Binding Sites

MicroRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. It is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

XIII. Methods of Treatment

A genetic disease is caused by a mutation in the patient's genome. Often, the mutation results in a change in a protein, e.g., an amino acid substitution or a truncation. Genetic diseases can be dominant, i.e., one mutant gene is sufficient to cause the disease, or recessive, where a patient with one copy of the mutant gene is an asymptomatic carrier, and two copies of the mutant gene are necessary for the disease to result.

Disclosed herein are the approaches to treat or prevent genetic diseases, using the compositions and methods described herein.

One approach to treat or prevent genetic diseases is to repair (i.e., correct) one or more mutations in the disease-causing gene by HDR. In this approach, mutant allele(s) are corrected and restored to wild type state. It is believed that correction of the mutation to the corresponding wild-type sequence restores wild type protein production within the relevant cell type. The method described herein can be performed in all cell types.

In one embodiment, one mutant allele is repaired in the subject. For example, in a patient with an autosomal dominant genetic disease, the sole mutant allele in the cell is corrected so that the cell becomes wild-type at both loci. As another example, in a patient with an autosomal recessive genetic disease, one of the two mutant alleles in the cell is corrected, and so the cell becomes heterozygous, which is sufficient for normal functioning. As a recessive genetic disease only displays a phenotype when both alleles are mutated, repair of a single allele is adequate for a cure. In another embodiment, both mutant alleles are repaired in the subject. In either situation, the subjects can be cured of disease.

Correction of a mutation in the relevant gene may be performed prior to disease onset (e.g., prior to the appearance of symptoms) or after disease onset, for instance, early in the disease course.

In one embodiment, the method comprises initiating treatment of a subject prior to disease onset. In one embodiment, the method comprises initiating treatment of a subject after disease onset. In one embodiment, the method comprises initiating treatment of a subject well after disease onset, e.g., 1, 2, 3, 4, 5, 6, 7, 8, 9, 10, 12, 24, or 36 months after onset of the disease. It is believed that this may be effective if subjects did not present to physician until well into the course of illness.

In one embodiment, the method comprises initiating treatment of a subject in an advanced stage of disease.

Overall, initiation of treatment for subjects at all stages of disease is expected to prevent negative consequences of disease and be of benefit to subjects.

In one embodiment, the method comprises initiating treatment of a subject prior to disease expression. In one embodiment, the method comprises initiating treatment of a subject in an early stage of disease, e.g., when a subject has tested positive for the disease but has no signs or symptoms associated with the disease.

In one embodiment, the method comprises initiating treatment of a subject who has tested positive for the mutation underlying the disease, based on diagnosis via electrophoresis, genotyping, family history or other diagnostic criteria.

In one embodiment, the present disclosure provides a method of treating a subject suffering from a disease or disorder, by contacting a cell, or a population of cells, from the subject with (a) a gRNA molecule, (b) a RNA-guided nuclease molecule, and (c) a heterologous Repair-Modulating Enzyme Molecule (RMEM), wherein the gRNA molecule and the RNA-guided nuclease molecule interact with a nucleic acid at a target position, resulting in a cleavage event, wherein the cleavage event is repaired by at least one DNA repair pathway that is modulated by the RMEM, and wherein the sequence of the nucleic acid after the cleavage event is different than the sequence of the nucleic acid prior to the cleavage event, thereby treating the subject suffering from the disease or disorder. In another embodiment, the method further comprises contacting the cell from the subject with a second gRNA molecule, wherein the second gRNA molecule and the RNA-guided nuclease molecule interact with the nucleic acid, resulting in a second cleavage event. In yet another embodiment, the contacting occurs ex vivo. In another embodiment, the contacting occurs in vivo. In other embodiments, the cleavage event is repaired by a process selected from the group consisting of an insertion, a deletion, a gene correction and a gene conversion.

EXAMPLES

The following Examples are merely illustrative and are not intended to limit the scope or content of the invention in any way.

Example 1: Set-Up and Optimization of RMEM Expression to Modulate Repair Pathway Choice in Response to an RNA-Guided Endonuclease Lesion This example demonstrates how RMEM expression was optimized and quality controlled. The RMEM may comprise histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins described herein. To identify the optimal conditions for RMEM expression, validation experiments to assess RMEM expression level and cellular viability as a result of RMEM expression were performed. First, as shown in FIG. 1A, the expression constructs for the cellular viability and expression analysis were generated by cloning, to contain an N-terminal nuclear localization signal, the cDNA of the RMEM, and a C-terminal 3×FLAG tag. Various concentrations (0.125 µg, 0.25 µg, 0.5 µg and 1 µg) of RMEM, RNA-guided nuclease, and gRNA were delivered to U2OS cells by nucleofection for subsequent expression and viability analysis on day 3 (FIG. 1B). Cellular viability as a consequence of RMEM expression was assessed using the resazurin cell viability assay on day 3 after nucleofection (FIG. 1C, top panel). In addition, RMEM expression was assessed by Western Blot analysis using an antibody against the C-terminal 3×FLAG tag present in the cDNA construct on day 3 after nucleofection (FIG. 1C bottom panel). The viability and expression analysis data were analyzed and the optimal RMEM concentration was determined to ensure optimal cellular viability with optimal RMEM expression.

Example 2. Workflow of RMEM Expression Screen to Modulate Repair Pathway Choice and Repair Outcomes in Response to an RNA-Guided Nuclease Lesion After determining the optimal concentration to obtain acceptable RMEM expression with acceptable cellular viability, a screen to assess the ability of RMEMs to modulate repair pathway choice and repair outcomes was performed. The RMEM may comprise histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins described herein. First, a cDNA construct to express the RMEM was generated that contains an N-terminal NLS fused to the cDNA of the RMEM (FIG. 2A). This construct does not contain a 3×FLAG to avoid interference of the tag with protein function. An RNA-guided nuclease targeting the human HBB gene in the region of the sickle cell anemia-causing mutation, a guide RNA, the RMEM, and a single-stranded oligonucleotide donor (ssODN) were administered to U2OS cells by nucleofection on day 0 (FIG. 2B). As a control, the RNA-guided nuclease was administered to cells with the ssODN but in the absence of the RMEM. On day 5, cells were harvested in order to assess the frequency and nature of mutations at the target site. This is achieved by 1) isolating genomic DNA from the control (no RMEM expression) and treated (RMEM expressing) cells, 2) PCR amplifying the DNA encompassing the region targeted for disruption or correction, 3) sequencing the amplified DNA products, and 4) determining the frequency of mutations/corrections by dividing the number of sequence reads harboring nucleotide insertions, deletions, gene conversions (from the endogenous HBD gene as a surrogate for homologous recombination) and gene corrections (from the ssODN through a sub-pathway of HDR referred to as SSTR) by the total number of sequence reads comprising the targeted region.

Figure 4B:
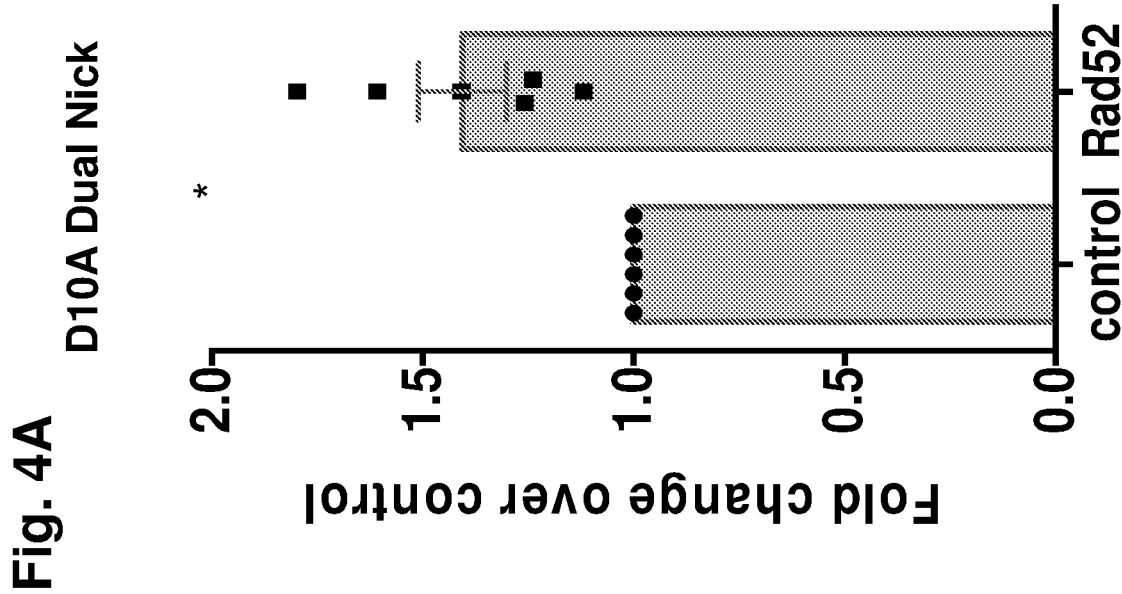
FIG. 4B shows the cDNA expression of Rad52 enhances gene correction in the context of a D10A single nick lesion induced by D10A Cas9 with gRNA HBB8.

Example 3. cDNA Expression of Rad52 Enhances Gene Correction and Reduces Gene Conversion and Deletion Formation In this example, the RMEM Rad52, an RNA-guided nuclease, a guide RNA, and a ssODN were administered to U2OS cells by nucleofection on day 0. Sequencing analysis showed that Rad52 expression led to an increase in gene correction, and to a decrease in gene conversion and the formation of deletions. An example of a decrease in deletion and gene conversion frequency is shown in FIG. 3A and FIG. 3B, respectively. Examples of an increase in ssODN-mediated gene correction are shown in FIG. 4A and FIG. 4B. In these examples, 500 ng of Rad52 was nucleofected into 200000 U2OS cells along with 250 ng of gRNA HBB8 alone or 250 ng of each gRNA HBB8 and HBB 15, 250 ng of the indicated Cas9 variant, and 50 pmols of ssODN.

Example 4. Rad52 Protein Enhances Gene Correction and Reduces Gene Conversion and Deletion Formation This example demonstrates an increase in gene correction and a decrease in the formation of deletions and gene conversion by administering to the cells an RNA-guided nuclease, a guide RNA, an ssODN, and the RMEM Rad52 as a protein. For purification of the Rad52 protein, a 1.3 kb gene segment corresponding to the 427 residues of Rad52 was obtained by gene synthesis with appended SapI Electra cloning arms (DNA 2.0 cloning system) and a C-term nucleoplasmin NLS. The synthetic construct cloned into pUC57 vector was excised by SapI digestion and Electra-cloned (DNA 2.0, Electra cloning system) into pD441-NH, pD441-CH (high copy) and pD421-NH (low copy) E. coli expression vectors.

After plasmids containing the Rad52 gene (either N-term His (high copy), C-term His (high copy), or N-term His (low copy) were transformed or electroporated into bacterial expression strains, protein was expressed and purified using the following method. The Rad52 construct contained an N-terminal SV40 NLS sequence (PKKKRKV) but was also amenable to having a nucleoplasmin NLS on either N- or C-termini instead. After plasmids were transformed or electroporated into protein expression bacteria cells (e.g., Rosetta 2 cells) several resulting colonies were added to 0.5 mL Brain Heart and Lung (BHL) media or another rich media without antibiotics. After 30 min to 1 hour, or when cell suspension was visibly cloudy, 0.5 mL BHL media or other rich media and antibiotics (chloramphenicol and kanamycin) were added to culture. The culture volume was doubled once the culture became visibly cloudy (OD=0.6) until volume reached 8 mL. Full culture was then transferred up to 1 L of Terrific broth (Teknova) media+antibiotics+1 mL 1000× metals solution (Teknova)+200 µL of 1 M magnesium sulfate solution. Cultures were grown at 37° C. Culture OD was measured after 1-2 hours or when the culture flask became slightly cloudy. At this point, the OD was measured every 1 hour or when appropriate until OD reached 1.0-1.5. Once OD reached 1.0-1.5, the flask was transferred to a lower temperature (18° C. to 25° C.) and the OD was checked again 30 minutes to 1 hour later. When the culture reached an OD of ~2.0, protein expression was induced by adding IPTG. The cells were grown at 18° C. for 12-16 hours (this time can be varied as necessary up to 3 days). Cultures were then harvested and pelleted using a large centrifuge and either lysed immediately or kept frozen at −80 C till the day of lysis.

Cell pellets expressing Rad52 were lysed using a microfluidizer wherein 1-10 g of dry cell pellet was resuspended with 70 mL of lysis buffer (50 mM Tris pH 8.0, 1 mM TCEP [tris(2-carboxyethyl)phosphine)] or DTT (dithiothreitol), 10-20% glycerol, and 300-1000 mM NaCl or KCl. Alternatively, cells were lysed and folded Rad52 was extracted using the BPER (ThermoFisher) chemical lysis kit, the BugBuster (EMD Millipore) chemical lysis kit, or an in-house chemical lysis reagent containing the same buffer but also in the presence of 1% Triton X-100 to break down cell membranes. Finally, a sonicator can be used to lyse cells using the same lysis buffer in the microfluidizer method but without 1% Triton X-100 or any other mild zwitter-ion detergent.

Cell lysate was spun down in a centrifuge and cell debris pellet was discarded. The supernatant was filtered through a 0.2 µm or 0.45 µm filter and loaded onto either a HisTrap Ni-NTA column (GE Healthcare) on onto a gravity column using HisPur Ni-NTA slurry (Thermo Fisher). In both cases the HisTrap or slurry in the gravity column were equilibrated with lysis buffer before being exposed to several 5x-20× column volume washes with lysis buffer also containing 30 mM imidazole. Finally, His-tagged Rad52 was eluted from Ni-NTA resin from either the HisTrap or gravity column using lysis buffer with 250-500 mM imidazole.

Rad52 protein was then concentrated using a 0.2 µm or 0.45 µm filter with a molecular weight cutoff of 30 kDa or less to approximately 10 mL and loaded onto an AKTA Pure (GE Healthcare) FPLC instrument equipped with a cation exchange column after diluting into a final volume of 50 mL of 50 mM HEPES pH7.5, 1 mM TCEP or DTT, 10-20% glycerol a d 100-150 mM NaCl or KCl. HEPES can be substituted for any buffer that has a buffering capacity in the range of pH 6.5-8.5. Rad52 protein was eluted into 2 mL fractions, yielding one predominant peak as detected by UV-absorbance on the FPLC instrument. Fractions from this peak were pooled and Rad52 was determined to be present and of high purity as analyzed by SDS-PAGE, which showed a clear band at the expected 49 kDa molecular weight marker for the Rad52 monomer as well as a clean band above 250 kDa marker (approximately 550 kDa in molecular weight) which consists of the Rad52 undecamer (11 Rad52 proteins bound together which is its functional oligomeric structure in solution). In addition, inspection of the Rad52 absorbance spectra showed a clean protein without measurable nucleic acid contamination as measured by 260/280 UV-absorbance ratio.

Pooled fractions of Rad52 were concentrated down to 200 µM based on the predicted extinction coefficient of Rad52 ($41370$ $M^{-1}$ cm) as indicated on UniProt Prot-param tool on the NCBI website and the measured 280 absorbance. These aliquots were either stored at 4 C for immediate use or flash-frozen in liquid nitrogen and stored at −80 C for long term storage.

Figure 5A:
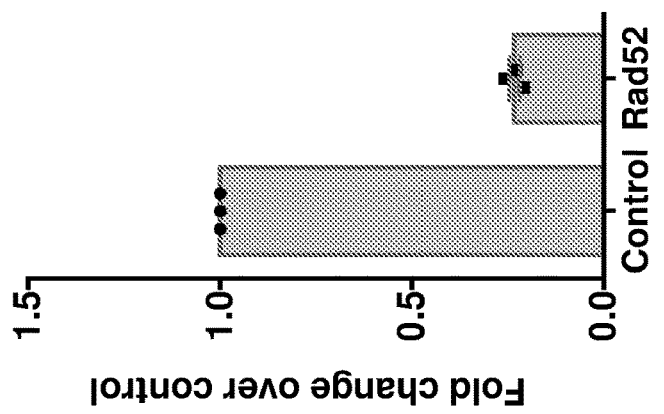
FIG. 5A shows the addition of Rad52 protein enhances gene correction in the context of a WT DSB induced by WT Cas9 with gRNAs HBB8.
Figure 5B:
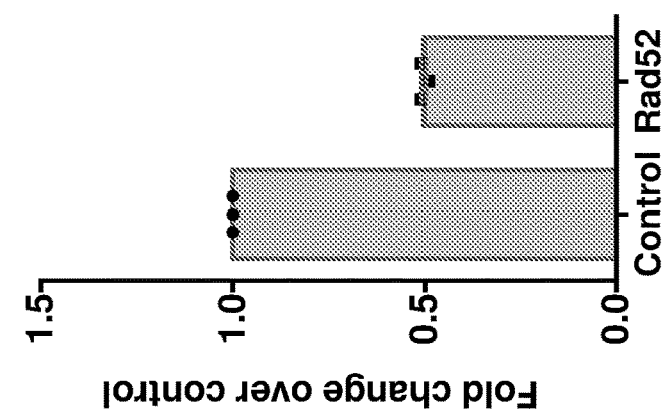
FIG. 5B shows the addition of Rad52 protein represses the formation of deletions in the context of a WT DSB induced by WT Cas9 with gRNAs HBB8.
Figure 5C:
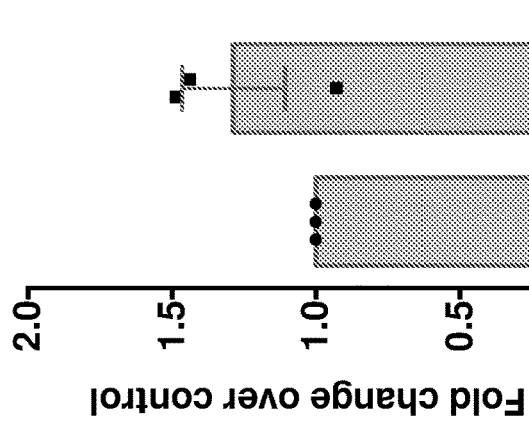
FIG. 5C shows the addition of Rad52 protein represses gene conversion in the context of a WT DSB induced by WT Cas9 with gRNAs HBB8.

Examples of an increase in ssODN-mediated gene correction and the decrease in deletions and gene conversion frequency upon Rad52 protein expression is shown FIGS. 5A, B, C, respectively. In this example, 150 pmols of Rad52 purified protein was delivered to 200000 U2OS cells with 15 pmols of WT Cas9, 18 pmols of gRNA HBB8, and 50 pmols of ssODN.

Example 5. 53BP1 Dominant Negative Enhances Gene Correction and Reduces the Formation of Insertions This example demonstrates an increase in gene correction and a decrease in the formation of insertions by administering to the cells an RNA-guided nuclease, a guide RNA, an ssODN, and the RMEM 53BP1 Dominant Negative (DN). Examples of an increase in ssODN-mediated gene correction with either the long form of 53BP1 dominant negative (53BP1-DN(long)), or the short form of 53BP1 dominant negative (53BP1-DN(short)), are shown in FIG. 6A and FIG. 6B, respectively. In this example, 500 ng of either 53BP1-DN (long) or 53BP1-DN(short) were nucleofected into 200000 U2OS cells along with 250 ng of gRNA HBB8 alone or 250 ngs of gRNAs HBB8 and HBB 15, 250 ng of the indicated Cas9 variant, and 50 pmols of ssODN. Examples of a decrease in insertion formation with the short form of 53BP1 dominant negative (53BP1-DN(short)) are shown in FIG. 7. In this example, 500 ng of 53BP1-DN (short) was nucleofected into 200000 U2OS cells along with 250 ng of gRNA HBB8 alone or 250 ng each of gRNAs HBB8 and HBB15, 250 ng of the indicated Cas9 variant, and 50 pmols of ssODN.

Example 6. TdT Enhances the Formation of Insertions and Reduces the Formation of Deletions, Gene Conversion, and Gene Correction This example demonstrates an increase in the formation of insertions and a decrease in gene conversion, gene correction and the formation of deletions by administering to the cells an RNA-guided nuclease, a guide RNA, an ssODN, and the RMEM TdT. An example of an increase the formation of insertions is shown in FIG. 8A. An example of a decrease in the formation of deletions, gene conversion, and ssODN-mediated gene correction is shown in FIGS. 8B, 8C, and 8D, respectively. For this example, 500 ng of TdT was nucleofected into 200000 U2OS cells along with 250 ng of gRNA HBB8 or 250 ng each of gRNAs HBB8 and HBB 15, 250 ng of the indicated Cas9 variant, and 50 pmols of ssODN.

Example 7. Rad51 Reduces Gene Conversion and Gene Correction

This example demonstrates a reduction in gene conversion and gene correction by administering to the cells an RNA-guided nuclease, a guide RNA, an ssODN, and the RMEM Rad51. Examples of a decrease in gene conversion and gene correction are shown in FIGS. 9A and 9B, respectively. For this example, 500 ng of Rad51 was nucleofected into 200000 U2OS cells along with 250 ng of gRNA HBB8 or 250 ng each of gRNAs HBB8 and HBB 15, 250 ng of the indicated Cas9 variant, and 50 pmols of ssODN.

Example 8. RPA Reduces Gene Conversion

This example demonstrates a reduction in gene conversion by administering to the cells an RNA-guided nuclease, a guide RNA, an ssODN, and the RMEM RPA. Examples of a decrease in gene conversion are shown in FIG. 10. For this example, 500 ng of RPA was nucleofected into 200000 U2OS cells along with 250 ng of gRNA HBB8 or 250 ng each of gRNAs HBB8 and HBB 15, 250 ng of the indicated Cas9 variant, and 50 pmols of ssODN.

Example 9. Artemis Enhances the Formation of Deletions

Figure 11:
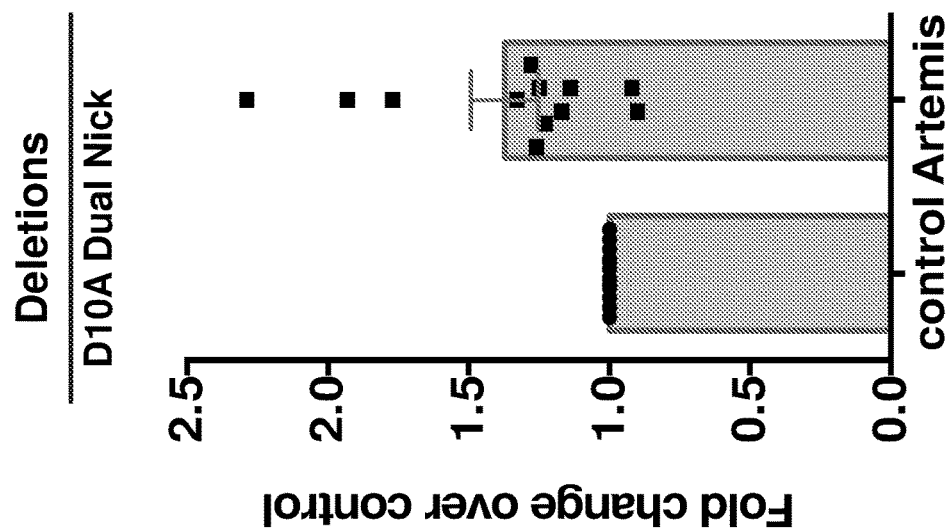
FIG. 11 shows the cDNA expression of Artemis enhances the formation of deletions in the context of D10A-induced dual nick lesions with gRNAs HBB8 and HBB15.

This example demonstrates an increase in the formation of deletions by administering to the cells an RNA-guided nuclease, a guide RNA, an ssODN, and the RMEM Artemis. Examples of an increase in deletion formation are shown in FIG. 11. For this example, 500 ng of T5 Artemis was nucleofected into 200000 U2OS cells along with 250 ng each of gRNAs HBB8 and HBB15, 250 ng of the indicated Cas9 variant, and 50 pmols of ssODN.

Figure 12A:
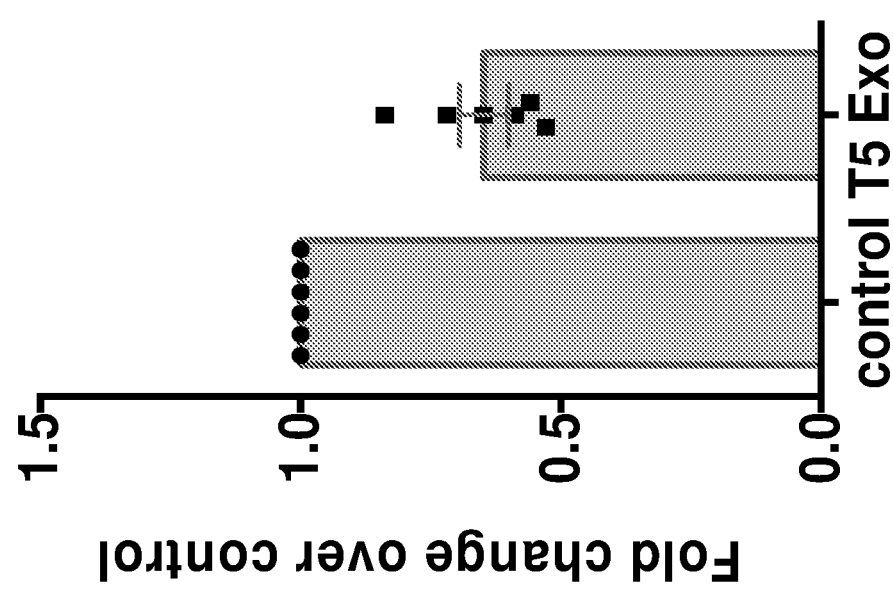
FIG. 12A shows the cDNA expression of T5 Exonuclease (T5 Exo) represses the formation of insertions in the context of N863A-induced dual nick lesions with gRNAs HBB8 and HBB15.
Figure 12B:
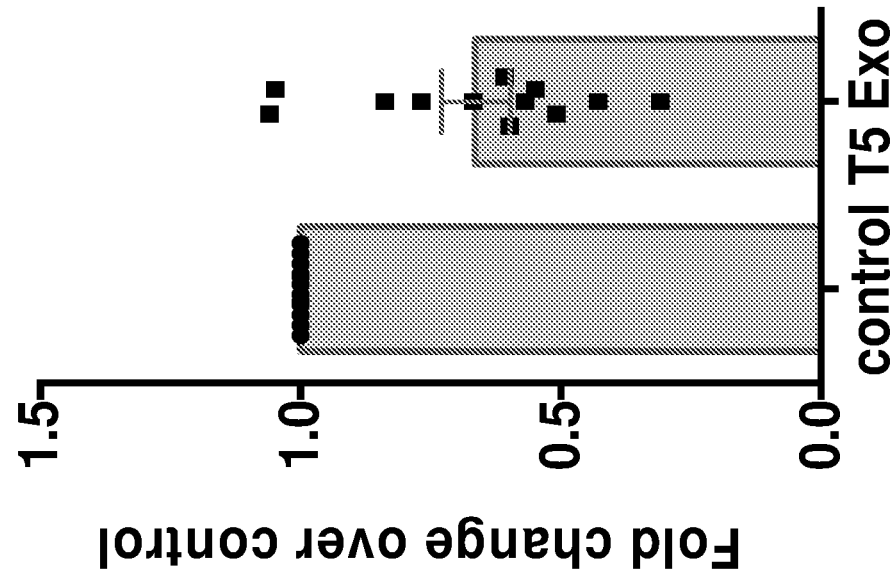
FIG. 12B shows the cDNA expression of T5 Exonuclease (T5 Exo) represses gene correction in the context of N863A-induced dual nick lesions with gRNAs HBB8 and HBB 15.

Example 10. T5 Exonuclease Reduces the Formation of Insertions and Gene Correction This example demonstrates a reduction in the formation of insertions and gene correction by administering to the cells an RNA-guided nuclease, a guide RNA, an ssODN, and the RMEM T5 Exonuclease. Examples of a decrease in insertion and gene correction are shown in FIGS. 12A and 12B, respectively. For this example, 500 ng of T5 Exonulcease was nucleofected into 200000 U2OS cells along with 250 ng each of gRNAs HBB8 and HBB 15, 250 ng of the indicated Cas9 variant, and 50 pmols of ssODN.

Example 11. ERCC1 Reduces Gene Conversion

Figure 13:
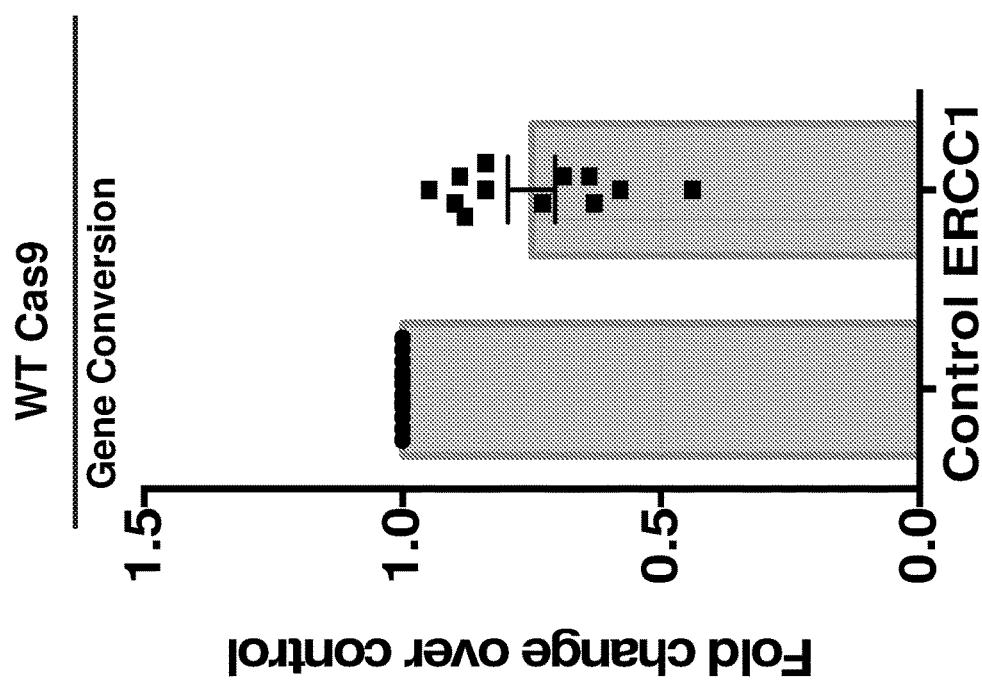
FIG. 13 shows the cDNA expression of ERCC1 represses gene conversion in the context of WT Cas9-induced DSB using gRNA HBB8.

This example demonstrates a reduction in the formation of insertions by administering to the cells an RNA-guided nuclease, a guide RNA, an ssODN, and the RMEM ERCC1. Examples of a decrease gene conversion are shown in FIG. 13. For these examples, 500 ng of ERCC1 was nucleofected into 200000 U2OS cells along with 250 ng of gRNA HBB8, 250 ng of the indicated Cas9 variant, and 50 pmols of ssODN.

Example 12: Enhancing Target Nucleic Acid Disruption in Cultured Cells Using a Cas9, a gRNA, and an RMEM This example demonstrates an increase in the frequency of mutations (e.g., nucleotide insertions and/or deletions), and/or an increase in the size of nucleotide deletions at a target site in cultured cells by administering to the cells a Cas9 molecule, an RMEM, and one or more gRNAs. The RMEM may comprise histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins described herein. The Cas9 molecule and RMEM are administered as a DNA expression vector, an mRNA or, a protein. The one or more gRNAs are administered as DNA expression vectors or RNA molecules. The Cas9, RMEM, and gRNA molecules are introduced into the cells by methods known in the art such as viral transduction, non-viral transfection or electroporation.

At various time points, cells are harvested in order to assess the frequency and nature of mutations at the target site. This is achieved by 1) isolating genomic DNA from the control and treated cells, 2) PCR amplifying the DNA encompassing the region targeted for disruption, 3) sequencing the amplified DNA products, and 4) determining the frequency of mutations by dividing the number of sequence reads harboring nucleotide insertions and/or deletions by the total number of sequence reads comprising the targeted region. Treatment of cells with a gRNA, a Cas9, and an RMEM is shown to increase the rate of target site disruption and/or the size of nucleotide deletions at the target site.

Example 13: Enhancing HDR-Mediated Alteration of a Target Nucleic Acid in Cultured Cells Using a an RMEM This example demonstrates an increased rate of HDR-mediated nucleic acid modification at a target site in cultured cells by administering to the cells a Cas9 molecule, a RMEM, one or more gRNAs, and an HDR donor nucleic acid template. The RMEM comprises histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins listed herein. The Cas9 molecule and the RMEM are administered as a DNA expression vector, an mRNA or a protein. The one or more gRNAs are administered as DNA expression vectors or RNA molecules. The donor template is provided as a plasmid DNA, a linear double-stranded DNA, a single-stranded oligonucleotide or viral genomic DNA, as described above). The Cas9 molecule, RMEM, gRNAs, and donor template are introduced into the cells by methods known in the art such as viral transduction, non-viral transfection or electroporation.

At various time points, cells are harvested in order to assess the rate of nucleic acid modification by HDR. This is achieved by 1) isolating genomic DNA from the Cas9 control and treated cells, 2) PCR amplifying the DNA encompassing the region targeted for modification, 3) sequencing the amplified DNA products, and 4) determining the frequency of HDR-mediated alteration by dividing the number of sequence reads containing the donor template-specified sequence by the total number of sequence reads comprising the targeted region. Treatment of cells with an RMEM is shown to increase the rate of HDR-mediated nucleic acid modification.

Example 14: Enhancing Target Nucleic Acid Disruption in a Tissue of an Animal Using a RMEM This example demonstrates an increase in the frequency of mutations (e.g., nucleotide insertions and/or deletions), and/or an increase in the size of nucleotide deletions at a target site in a tissue of an animal by administering to the animal a Cas9 molecule, a RMEM, and one or more gRNAs. The RMEM may comprise histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins listed herein. The Cas9 molecule and the RMEM are administered as a DNA expression vector, an mRNA or a protein. The one or more gRNAs are administered as DNA expression vectors or RNA molecules. The molecules are introduced into the animal by local or systemic administration of viral vectors or non-viral delivery vehicles.

At various time points, tissues are harvested from treated animals in order to assess the frequency and nature of mutations at the target site. This is achieved by 1) isolating genomic DNA from the Cas9 control and RMEM-treated tissues, 2) PCR amplifying the DNA encompassing the region targeted for disruption, 3) sequencing the amplified DNA products, and 4) determining the frequency of mutations by dividing the number of sequence reads harboring nucleotide insertions and/or deletions by the total number of sequence reads comprising the targeted region. Treatment of animals with a RMEM is shown to increase the rate of target site disruption and/or the size of nucleotide deletions at the target site.

Example 15: Enhancing HDR-Mediated Alteration of a Target Nucleic Acid in a Tissue of an Animal Using an RMEM This study demonstrates an increased rate of HDR-mediated nucleic acid modification at a target site in a tissue of an animal by administering to the animal a Cas9 molecule, an RMEM, one or more gRNAs, and an HDR donor nucleic acid template. The RMEM may comprise histone acetyltransferase activity, histone deacetylase activity, histone methyltransferase activity, methyl-histone binding, chromatin remodeling activity, histone chaperone activity, endonuclease activity, exonuclease activity, or DNA helicase activity, e.g., one of the proteins listed herein. The Cas9 molecule and the RMEM are administered as a DNA expression vector, an mRNA or a protein. The one or more gRNAs are administered as DNA expression vectors or RNA molecules. The donor template is provided as a plasmid DNA, a linear double-stranded DNA, a single-stranded oligonucleotide or viral genomic DNA, as described above. The components are introduced into the animal by local or systemic administration of viral vectors or non-viral delivery vehicles.

At various time points, tissues are harvested in order to assess the rate of nucleic acid modification by HDR. This is achieved by 1) isolating genomic DNA from the Cas9 control and RMEM-treated tissues, 2) PCR amplifying the DNA encompassing the region targeted for modification, 3) sequencing the amplified DNA products, and 4) determining the frequency of HDR-mediated alteration by dividing the number of sequence reads containing the donor template-specified sequence by the total number of sequence reads comprising the targeted region. Treatment of cells with an RMEM in addition to a gRNA molecule, a Cas9 molecule, and the template is shown to increase the rate of HDR-mediated nucleic acid modification.

INCORPORATION BY REFERENCE

All publications, patents, and patent applications mentioned herein are hereby incorporated by reference in their entirety as if each individual publication, patent, or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

Other embodiments are within the following claims.

SEQUENCE LISTING (161 sequences)

SEQ ID NO: 1 - protein, 20 aa, Artificial Sequence
  Synthetic: linker
  misc_feature (1)..(20): At least one Gly Ser must be present and the rest may be present or absent
GSGSGSGSGSGSGSGSGSGS

SEQ ID NO: 2 - protein, 30 aa, Artificial Sequence
  Synthetic: linker
  misc_feature (1)..(30): At least one Gly Gly Ser must be present and the rest may be present or absent
GGSGGSGGSGGSGGSGGSGGSGGSGGSGGS

SEQ ID NO: 3 - protein, 16 aa, Artificial Sequence
  Synthetic: linker
SGSETPGTSESATPES

SEQ ID NO: 4 - protein, 48 aa, Artificial Sequence
  Synthetic: linker
  misc_feature (1)..(48): At least one GSAGSAAGSGEF must be present and the rest may be present or absent
GSAGSAAGSGEFGSAGSAAGSGEFGSAGSAAGSGEFGSAGSAAGSGEF

SEQ ID NO: 5 - protein, 48 aa, Artificial Sequence
  Synthetic: linker
  misc_feature (1)..(48): At least one SIVAQLSRPDPA must be present and the rest may be present or absent
SIVAQLSRPDPASIVAQLSRPDPASIVAQLSRPDPASIVAQLSRPDPA

SEQ ID NO: 6 - DNA, 5 bp, Artificial Sequence
  Synthetic: sequence motif
  misc_feature (1)..(1): n is a, c, g, or t
  misc_feature (4)..(4): n is a, c, g, or t
nggng

SEQ ID NO: 7 - DNA, 7 bp, Artificial Sequence
  Synthetic: sequence motif
  misc_feature (1)..(2): n is a, c, g, or t
nnagaaw

SEQ ID NO: 8 - DNA, 4 bp, Artificial Sequence
  Synthetic: sequence motif
  misc_feature (1)..(1): n is a, c, g, or t
naar

SEQ ID NO: 9 - DNA, 5 bp, Artificial Sequence
  Synthetic: sequence motif
  misc_feature (1)..(2): n is a, c, g, or t
nngrr

SEQ ID NO: 10 - DNA, 6 bp, Artificial Sequence
  Synthetic: sequence motif
  misc_feature (1)..(2): n is a, c, g, or t
nngrrv

SEQ ID NO: 11 - DNA, 8 bp, Artificial Sequence
  Synthetic: sequence motif
  misc_feature (1)..(4): n is a, c, g, or t
nnnngatt

SEQ ID NO: 12 - DNA, 7 bp, Artificial Sequence
  Synthetic: sequence motif
  misc_feature (1)..(3): n is a, c, g, or t
nnngctt

SEQ ID NO: 13 - protein, 16 aa, Artificial Sequence
  Synthetic: linker
SGSETPGTSESATPES

SEQ ID NO: 14 - DNA, 4107 bp, S. pyogenes
  misc_feature (1)..(4107): exemplary codon optimized nucleic acid sequence encoding a Cas9 molecule of S. pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 15 - protein, 1368 aa, S. pyogenes [sequence omitted]

SEQ ID NO: 16 - DNA, 3249 bp, N. meningitidis
  misc_feature (1)..(3249): exemplary codon optimized nucleic acid sequence encoding a Cas9 molecule of N. meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 17 - protein, 1082 aa, N. meningitidis
  misc_feature (1)..(1082): amino acid sequence of a N. meningitidis Cas9 molecule
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 18 - protein, 1053 aa, S. aureus
  misc_feature (1)..(1053): amino acid sequence of a S. aureus Cas9 molecule
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 19 - DNA, 3159 bp, S. aureus
  misc_feature (1)..(3159): exemplary codon optimized nucleic acid sequence encoding a S. aureus Cas9 molecule
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 20 - protein, 533 aa, Unknown
  Endonuclease/Exonuclease:  Fan1
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRFCWLLLQ

SEQ ID NO: 21 - protein, 532 aa, Unknown
  Endonuclease/Exonuclease:  Apollo
MNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 22 - protein, 928 aa, Unknown [sequence omitted]

SEQ ID NO: 23 - protein, 291 aa, Unknown
  T5 exonuclease
MSKSWGKFIEEEEAEMASRRNLMIVDGTNLGFRFKHNNSKKPFASSYVSTIQSLAKSYSARTTIVLGDKGKSVFRLEHLPEYKGNRDEKYAQRTEEEKALDEQFFEYLKDAFELCKTTFPTFTIRGVEADDMAAYIVKLIGHLYDHVWLISTDGDWDTLLTDKVSRFSFTTRREYHLRDMYEHHNVDDVEQFISLKAIMGDLGDNIRGVEGIGAKRGYNIIREFGNVLDIIDQLPLPGKQKYIQNLNASEELLFRNLILVDLPTYCVDAIAAVGQDVLDKFTKDILEIAEQ

SEQ ID NO: 24 - protein, 908 aa, Unknown
  Endonuclease/Exonuclease: : Gen1
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQRFNRWNETSCNSSPQLLVTKKLAHCSVCSHPGSPKDHERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 25 - protein, 897 aa, Homo sapiens
  misc_feature (1)..(897): CtIP- isoform 1 CCDS 11875.1
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 26 - protein, 911 aa, Unknown
  Endonuclease/Exonuclease:  Dominant Negative CtIP (S327E, T847E, or S327E+T847E)
MNILGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKTDYKDHDGDYKDHDI

SEQ ID NO: 27 - protein, 680 aa, Homo sapiens
  misc_feature (1)..(680): Mre11- isoform 2 CCDS 8298.1
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 28 - protein, 1060 aa, Homo sapiens
  misc_feature (1)..(1060): DNA2 endonuclease (CCDS 44415.2)
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 29 - protein, 380 aa, Homo sapiens
  misc_feature (1)..(380): Fen1 CCDS 8010.1
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 30 - protein, 551 aa, Homo sapiens
  misc_feature (1)..(551): MUS81 endonuclease homolog (yeast), isoform CRA_b [Homo sapiens], CCDS 8115.1
MAAPVRLGRKRPLPACPNPLFVRWLTEWRDEATRSRRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGVSGEKAAALVDRYSTPASLLAAYDACATPKEQETLLSTIKCGRLQRNLGPALSRTLSQLYCSYGPLT

SEQ ID NO: 31 - protein, 236 aa, Homo sapiens
  misc_feature (1)..(236): TREX2 three prime repair exonuclease 2 [Homo sapiens])
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 32 - protein, 803 aa, Homo sapiens
  misc_feature (1)..(803): Exo1 Isoform 1 CCDS 44336.1
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 33 - protein, 1186 aa, Homo sapiens
  misc_feature (1)..(1186): XPG CCDS 32004.1
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 34 - protein, 916 aa, Homo sapiens
  misc_feature (1)..(916): XPF CCDS 32390.1
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 35 - protein, 318 aa, Homo sapiens
  misc_feature (1)..(318): APE-1 CCDS 9550.1
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 36 - protein, 342 aa, Homo sapiens
  misc_feature (1)..(342): APTX Isoform 1 CCDS 47956.1
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37 - protein, 511 aa, Homo sapiens
  misc_feature (1)..(511): APLF CCDS 1888.1
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 38 - protein, 692 aa, Homo sapiens
  misc_feature (1)..(692): Artemis Isoform 1 CCDS 31149.1
MSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 39 - protein, 297 aa, Homo sapiens
  misc_feature (1)..(297): ERCC1_HUMAN DNA excision repair protein ERCC-1
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 40 - protein, 641 aa, Homo sapiens
  misc_feature (1)..(641): Pif1 Isoform 1  CCDS 10195.2
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLESPDDDEAASDQENMDPIL

SEQ ID NO: 41 - protein, 707 aa, Homo sapiens
  misc_feature (1)..(707): Pif1 Isoform 2  CCDS 66797.1
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLAAEGRGNEDRCSGSSIRALGGDWWGLRLGAASKQRTELRCVSTARPSLAQPRTNTLQSLTKEHKLQNVHPYFKLLFQGINSVWGH

SEQ ID NO: 42 - protein, 954 aa, Homo sapiens
  misc_feature (1)..(954): HARP/ SMARCAL1  CCDS 2403.1
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 43 - protein, 1079 aa, Homo sapiens
  misc_feature (1)..(1079): ZRANB3 Isoform 1  CCDS 46419.1
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 44 - protein, 1077 aa, Homo sapiens
  misc_feature (1)..(1077): ZRANB3 Isoform 2
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 45 - protein, 625 aa, Homo sapiens
  misc_feature (1)..(625): ZRANB3 Isoform 3  CCDS 74580.1
MWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 46 - protein, 1432 aa, Homo sapiens
  misc_feature (1)..(1432): WRN CCDS 6082.1
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 47 - protein, 1417 aa, Homo sapiens
  misc_feature (1)..(1417): BLM Isoform 1 CCDS 10363.1
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 48 - protein, 1208 aa, Homo sapiens
  misc_feature (1)..(1208): RECQ4, CCDS 75804.1
MERLRDVRERLQAWERAFRRQRGRRPSQDDVEAAPEETRALYREYRTLKRTTGQAGGGLRSSESLPAAAEEAPEPRCWGPHLNRAATKSPQSTPGRSRQGSVPDYGQRLKANLKGTLQAGPALGRRPWPLGRASSKASTPKPPGTGPVPSFAEKVSDEPPQLPEPQPRPGRLQHLQASLSQRLGSLDPGWLQRCHSEVPDFLGAPKACRPDLGSEESQLLIPGESAVLGPGAGSQGPEASAFQEVSIRVGSPQPSSSGGEKRRWNEEPWESPAQVQQESSQAGPPSEGAGAVAVEEDPPGEPVQAQPPQPCSSPSNPRYHGLSPSSQARAGKAEGTAPLHIFPRLARHDRGNYVRLNMKQKHYVRGRALRSRLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGISTLLVLPTGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRVQRAFMQGQLRVVVATVAFGMGLDRPDVRAVLHLGLPPSFESYVQAVGRAGRDGQPAHCHLFLQPQGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARLQDWEDQVRCDIRQFLSLRPEEKFSSRAVARIFHGIGSPCYPAQVYGQDRRFWRKYLHLSFHALVGLATEELLQVAR

SEQ ID NO: 49 - protein, 649 aa, Homo sapiens
  misc_feature (1)..(649): RECQL1 CCDS 31756.1
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 50 - protein, 782 aa, Homo sapiens
  misc_feature (1)..(782): XPB CCDS 2144.1
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 51 - protein, 760 aa, Homo sapiens
  misc_feature (1)..(760): XPD Isoform 1 CCDS 33049.1
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 52 - protein, 736 aa, Homo sapiens
  misc_feature (1)..(736): transcription regulator protein BACH1 [Homo sapiens] CCDS 13585.1
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 53 - protein, 1219 aa, Homo sapiens
  misc_feature (1)..(1219): RTEL Isoform 1 CCDS 13531.1
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 54 - protein, 509 aa, Unknown
  Terminal Deoxynucleotidyl Transferase: TdT
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 55 - protein, 499 aa, Unknown
  Repair protein: 53BP1 dominant negative Mutant 1: 53bp1_(1221-1718)  with ATG start and TAA stop, AA-seq
MGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQ

SEQ ID NO: 56 - protein, 1208 aa, Homo sapiens
  misc_feature (1)..(1208): protein timeless homolog [Homo sapiens]
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDISPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 57 - protein, 301 aa, Homo sapiens
  misc_feature (1)..(301): TIMELESS-interacting protein isoform 1 [Homo sapiens]
MLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 58 - protein, 419 aa, Unknown
  Telomeric Protein: TRF1
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 59 - protein, 542 aa, Unknown
  Telomeric Protein: TRF2
MAAGAGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 60 - protein, 280 aa, Unknown
  Recombinant Protein: XRCC2
MCSAFHRAESGTELLARLEGRSSLKEIEPNLFADEDSPVHGDILEFHGPEGTGKTEMLYHLTARCILPKSEGGLEVEVLFIDTDYHFDMLRLVTILEHRLSQSSEEIIKYCLGRFFLVYCSSSTHLLLTLYSLESMFCSHPSLCLLILDSLSAFYWIDRVNGGESVNLQESTLRKCSQCLEKLVNDYRLVLFATTQTIMQKASSSSEEPSHASRRLCDVDIDYRPYLCKAWQQLVKHRMFFSKQDDSQSSNQFSLVSRCLKSNSLKKHFFIIGESGVEFC

SEQ ID NO: 61 - protein, 353 aa, Unknown
  Recombinant Protein: RecA
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGENVVGSETRVKVVKNKIAAPFKQAEFQILYGEGINFYGELVDLGVKEKLIEKAGAWYSYKGEKIGQGKANATAWLKDNPETAKEIEKKVRELLLSNPNSTPDFSVDDSEGVAETNEDF

SEQ ID NO: 62 - protein, 460 aa, Unknown
  Recombinant Protein: RadA
MAKAPKRAFVCNECGADYPRWQGQCSACHAWNTITEVRLAASPMVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 63 - protein, 418 aa, Homo sapiens
  misc_feature (1)..(418): RAD52_HUMAN DNA repair protein RAD52 homolog
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 64 - protein, 471 aa, Unknown
  Recombinant Protein: Rad52-yeast
MNEIMDMDEKKPVFGNHSEDIQTKLDKKLGPEYISKRVGFGTSRIAYIEGWRVINLANQIFGYNGWSTEVKSVVIDFLDERQGKFSIGCTAIVRVTLTSGTYREDIGYGTVENERRKPAAFERAKKSAVTDALKRSLRGFGNALGNCLYDKDFLAKIDKVKFDPPDFDENNLFRPTDEISESSRTNTLHENQEQQQYPNKRRQLTKVTNTNPDSTKNLVKIENTVSRGTPMMAAPAEANSKNSSNKDTDLKSLDASKQDQDDLLDDSLMFSDDFQDDDLINMGNTNSNVLTTEKDPVVAKQSPTASSNPEAEQITFVTAKAATSVQNERYIGEESIFDPKYQAQSIRHTVDQTTSKHIPASVLKDKTMTTARDSVYEKFAPKGKQLSMKNNDKELGPHMLEGAGNQVPRETTPIKTNATAFPPAAAPRFAPPSKVVHPNGNGAVPAVPQQRSTRREVGRPKINPLHARKPT

SEQ ID NO: 65 - protein, 261 aa, Unknown
  Recombinant Protein: RPA-4 subunit
MSKSGFGSYGSISAADGASGGSDQLCERDATPAIKTQRPKVRIQDVVPCNVNQLLSSTVFDPVFKVRGIIVSQVSIVGVIRGAEKASNHICYKIDDMTAKPIEARQWFGREKVKQVTPLSVGVYVKVFGILKCPTGTKSLEVLKIHVLEDMNEFTVHILETVNAHMMLDKARRDTTVESVPVSPSEVNDAGDNDESHRNFIQDEVLRLIHECPHQEGKSIHELRAQLCDLSVKAIKEAIDYLTVEGHIYPTVDREHFKSAD

SEQ ID NO: 66 - protein, 3418 aa, Homo sapiens [sequence omitted]

SEQ ID NO: 67 - protein, 70 aa, Homo sapiens
  misc_feature (1)..(70): 26S proteasome complex subunit DSS1 [Homo sapiens]
MSEKKQPVDLGLLEEDDEFEEFPAEDWAGLDEDEDAHVWEDNWDDDNVEDDFSNQLRAELEKHGYKMETS

SEQ ID NO: 68 - protein, 1186 aa, Homo sapiens [sequence omitted]

SEQ ID NO: 69 - protein, 339 aa, Homo sapiens
  misc_feature (1)..(339): RAD51 [Homo sapiens], CCDS 10062.1
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 70 - protein, 350 aa, Homo sapiens
  misc_feature (1)..(350): DNA repair protein RAD51 homolog 2 isoform 1 [Homo sapiens]
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYGNS

SEQ ID NO: 71 - protein, 376 aa, Homo sapiens
  misc_feature (1)..(376): DNA repair protein RAD51 homolog 3 isoform 1 [Homo sapiens]
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 72 - protein, 346 aa, Homo sapiens
  misc_feature (1)..(346): DNA repair protein XRCC3 [Homo sapiens]
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 73 - protein, 546 aa, Homo sapiens
  misc_feature (1)..(546): Tip60/KAT5 Isoform 1 CCDS8110.1
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 74 - protein, 513 aa, Homo sapiens
  misc_feature (1)..(513): Tip60/KAT5 Isoform 2  CCDS 31610.1
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 75 - protein, 461 aa, Homo sapiens
  misc_feature (1)..(461): Tip60/KAT5 Isoform 3 CCDS 8109.1
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 76 - protein, 494 aa, Homo sapiens
  misc_feature (1)..(494): Tip60/KAT5 Isoform 4  CCDS 55771.1
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 77 - protein, 419 aa, Homo sapiens
  misc_feature (1)..(419): HAT1  CCDS 2245.1
MAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMVIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 78 - protein, 305 aa, Homo sapiens
  misc_feature (1)..(305): SIRT6 Isoform 1 CCDS 12122.1
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPT

SEQ ID NO: 79 - protein, 328 aa, Homo sapiens
  misc_feature (1)..(328): SIRT6 Isoform 2  CCDS 54199.1
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 80 - protein, 2564 aa, Homo sapiens
  misc_feature (1)..(2564): SETD2 Isoform 1
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 81 - protein, 1714 aa, Homo sapiens
  misc_feature (1)..(1714): SETD2 Isoform 2
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDS

SEQ ID NO: 82 - protein, 1572 aa, Homo sapiens
  misc_feature (1)..(1572): SETD2 Isoform 3
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPS

SEQ ID NO: 83 - protein, 333 aa, Homo sapiens
  misc_feature (1)..(333): LEDGF Isoform 1  CCDS 6480.1
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 84 - protein, 530 aa, Homo sapiens
  misc_feature (1)..(530): LEDGF Isoform 2 CCDS 6479.1
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 85 - protein, 751 aa, Homo sapiens
  misc_feature (1)..(751): EZH2 Isoform 1  CCDS 5891.1
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHRKCNYSFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 86 - protein, 707 aa, Homo sapiens
  misc_feature (1)..(707): EZH2 Isoform 2  CCDS 5892.1
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 87 - protein, 737 aa, Homo sapiens
  misc_feature (1)..(737): EZH2 Isoform 3  CCDS 56518.1
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 88 - protein, 695 aa, Homo sapiens
  misc_feature (1)..(695): EZH2 Isoform 4  CCDS 56517.1
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 89 - protein, 746 aa, Homo sapiens
  misc_feature (1)..(746): EZH2 Isoform 5  CCDS 56516.1
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 90 - protein, 1556 aa, Homo sapiens
  misc_feature (1)..(1556): INO80 CCDS 10071.
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKANKQKASARNLFLTNSRKLAHQCMKEVRRAALQAQKNCKETLPRARRLTKEMLLYWKKYEKVEKEHRKRAEKEALEQRKLDEEMREAKRQQRKLNFLITQTELYAHFMSRKRDMGHDGIQEEILRKLEDSSTQRQIDIGGGVVVNITQEDYDSNHFKAQALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSSSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 91 - protein, 3230 aa, Homo sapiens
  misc_feature (1)..(3230): SRCAP CCDS 10689.2
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 92 - protein, 154 aa, Homo sapiens
  misc_feature (1)..(154): ZNHIT1/p18 CCDS 5716.1
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 93 - protein, 391 aa, Homo sapiens
  misc_feature (1)..(391): Nap1 CCDS 9013.1
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 94 - protein, 320 aa, Homo sapiens
  misc_feature (1)..(320): heterogeneous nuclear ribonucleoprotein A1 isoform a [Homo sapiens]
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 95 - protein, 182 aa, Homo sapiens
  misc_feature (1)..(182): UP1 Filament of HNRNPA1
KSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQ

SEQ ID NO: 96 - protein, 148 aa, Homo sapiens
  misc_feature (1)..(148): NABP2
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 97 - protein, 204 aa, Homo sapiens
  misc_feature (1)..(204): NABP1
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 98 - protein, 286 aa, Homo sapiens
  misc_feature (1)..(286): amino acid sequence for RNAse H1 CCDS 1647.1.
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 99 - protein, 299 aa, Homo sapiens
  misc_feature (1)..(299): amino acid sequence for RNAse H2 subunit A CCDS 12282.1.
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 100 - protein, 257 aa, Homo sapiens
  misc_feature (1)..(257): amino acid sequence for RNAse H2 subunit B CCDS 45047.1 (Isoform 1)
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKMAAQRQKRGK

SEQ ID NO: 101 - protein, 312 aa, Homo sapiens
  misc_feature (1)..(312): amino acid sequence for RNAse H2 subunit B. CCDS9425.1 (Isoform 2)
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 102 - protein, 164 aa, Homo sapiens
  misc_feature (1)..(164): amino acid sequence for RNAse H2 subunit C. CCDS8111.1
MESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 103 - protein, 2677 aa, Homo sapiens
  misc_feature (1)..(2677): amino acid sequence for Senataxin
MSTCCWCTPGGASTIDFLKRYASNTPSGEFQTADEDLCYCLECVAEYHKARDELPFLHEVLWELETLRLINHFEKSMKAEIGDDDELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINNASYNREIRHIRNSSVRTKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEPMKVQDSVLIKADNTIEGDNNEQNYIKDVKLEDHLLAGSCLKQSSKNIFTERAEDQIKISTRKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVLPKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFETVAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 104 - protein, 20 aa, Artificial Sequence
  Synthetic: linker
  misc_feature (1)..(20): At least one Gly Ser must be present and the rest may be present or absent
GSGSGSGSGSGSGSGSGSGS

SEQ ID NO: 105 - protein, 20 aa, Artificial Sequence
  Synthetic: linker
  misc_feature (1)..(20): At least one Gly Ser Gly Ser must be present and the rest may be present or absent
GSGSGSGSGSGSGSGSGSGS

SEQ ID NO: 106 - protein, 4 aa, Artificial Sequence
  Synthetic: linker
GSGS

SEQ ID NO: 107 - protein, 48 aa, Artificial Sequence; identical to SEQ ID NO: 4
  Synthetic: linker

SEQ ID NO: 108 - protein, 48 aa, Artificial Sequence; identical to SEQ ID NO: 5
  Synthetic: linker

SEQ ID NO: 109 - protein, 16 aa, Artificial Sequence
  Synthetic: linker
SGSETPGTSESATPES

SEQ ID NO: 110 - protein, 4 aa, Artificial Sequence
  Synthetic: linker
GSGS

SEQ ID NO: 111 - protein, 4 aa, Artificial Sequence
  Synthetic: linker
GGGS

SEQ ID NO: 112 - protein, 5 aa, Artificial Sequence
  Synthetic: linker
GGGGS

SEQ ID NO: 113 - protein, 4 aa, Artificial Sequence
  Synthetic: linker
GGSG

SEQ ID NO: 114 - protein, 12 aa, Artificial Sequence
  Synthetic: linker
SGSETPGTSESA

SEQ ID NO: 115 - protein, 16 aa, Artificial Sequence
  Synthetic: linker
SGSETPGTSESATPES

SEQ ID NO: 116 - protein, 21 aa, Artificial Sequence
  Synthetic: linker
SGSETPGTSESATPEGGSGGS

SEQ ID NO: 117 - protein, 3 aa, Artificial Sequence
  Synthetic: linker
GGS

SEQ ID NO: 118 - protein, 4 aa, Artificial Sequence
  Synthetic: linker
GSGS

SEQ ID NO: 119 - protein, 4 aa, Artificial Sequence
  Synthetic: linker
GGGS

SEQ ID NO: 120 - protein, 5 aa, Artificial Sequence
  Synthetic: linker
GGGGS

SEQ ID NO: 121 - protein, 4 aa, Artificial Sequence
  Synthetic: linker
GGSG

SEQ ID NO: 122 - protein, 12 aa, Artificial Sequence
  Synthetic: linker
SGSETPGTSESA

SEQ ID NO: 123 - protein, 16 aa, Artificial Sequence
  Synthetic: linker
SGSETPGTSESATPES

SEQ ID NO: 124 - protein, 21 aa, Artificial Sequence
  Synthetic: linker
SGSETPGTSESATPEGGSGGS

SEQ ID NO: 125 - protein, 30 aa, Artificial Sequence
  Synthetic: linker
  misc_feature (1)..(30): At least one Gly Gly Ser must be present and the rest may be present or absent
GGSGGGGSGGSGGSGGSGGSGGSGGSSGGS

SEQ ID NO: 126 - protein, 867 aa, Homo sapiens
  misc_feature (1)..(867): CtIP- isoform 2 CCDS 11874.1
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDESIMQICQQKKEKRNWLPAQDTDSATFHPTHQRIFGKLVFLPLRLVWKEVILRKILILVLVQKDVSLTTQYFLQKARSRRHRR

SEQ ID NO: 127 - protein, 584 aa, Unknown
  Endonuclease/Exonuclease: Dominant Negative CtIP (S327E, T847E, or S327E+T847E)
MNILGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVF

SEQ ID NO: 128 - protein, 708 aa, Homo sapiens
  misc_feature (1)..(708): Mre11- isoform 1CCDS8299.1
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 129 - protein, 846 aa, Homo sapiens
  misc_feature (1)..(846): Exo1 Isoform 2 CCDS 1620.1
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 130 - protein, 302 aa, Homo sapiens
  misc_feature (1)..(302): APTX Isoform 2 CCDS 56568.1
MSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 131 - protein, 288 aa, Homo sapiens
  misc_feature (1)..(288): APTX Isoform 3 CCDS 75827.1
MMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 132 - protein, 577 aa, Homo sapiens
  misc_feature (1)..(577): Artemis Isoform 2 CCDS 7105.1
MKHQERFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 133 - protein, 572 aa, Homo sapiens
  misc_feature (1)..(572): Artemis Isoform 3 CCDS 31150.1
MFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 134 - protein, 273 aa, Homo sapiens
  misc_feature (1)..(273): ERCC1_HUMAN Isoform 2 of DNA excision repair protein ERCC-1
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKARRLFDVLHEPFLKVP

SEQ ID NO: 135 - protein, 323 aa, Homo sapiens
  misc_feature (1)..(323): ERCC1_HUMAN Isoform 3 of DNA excision repair protein ERCC-1
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKVRALGKNPRSWGKERAPNKHNLRPQSFKVKKEPKTRHSGFRL

SEQ ID NO: 136 - protein, 225 aa, Homo sapiens
  misc_feature (1)..(225): ERCC1_HUMAN Isoform 4 of DNA excision repair protein ERCC-1
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 137 - protein, 1286 aa, Homo sapiens
  misc_feature (1)..(1286): BLM Isoform 2 CCDS 73782.1
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 138 - protein, 405 aa, Homo sapiens
  misc_feature (1)..(405): XPD Isoform 2 CCDS 46112.1
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGQAQHCGSSRNQKRSHP

SEQ ID NO: 139 - protein, 1243 aa, Homo sapiens
  misc_feature (1)..(1243): RTEL Isoform 2 CCDS 13530.3
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 140 - protein, 1300 aa, Homo sapiens
  misc_feature (1)..(1300): RTEL Isoform 3 CCDS 63331.1
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 141 - protein, 996 aa, Homo sapiens
  misc_feature (1)..(996): RTEL Isoform 4 CCDS 74751.1
MPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 142 - protein, 660 aa, Unknown
  Repair Protein: 53BP1 dominant negative Mutant 2: 53bp1_(1052-1710)  with ATG start and TAA stop, AA-seq
MDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTG

SEQ ID NO: 143 - protein, 200 aa, Homo sapiens
  misc_feature (1)..(200): TIMELESS-interacting protein isoform 2 [Homo sapiens]
MLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 144 - protein, 226 aa, Homo sapiens
  misc_feature (1)..(226): RAD52_HUMAN Isoform beta of DNA repair protein RAD52 homolog
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRLPLLGVSGRILYSLFSVHSVMCAGGLPTPTASAQTAPSSPCSSAVLRYAQEFWECTWKLYSGQRLPEITK

SEQ ID NO: 145 - protein, 139 aa, Homo sapiens
  misc_feature (1)..(139): RAD52_HUMAN Isoform gamma of DNA repair protein RAD52 homolog
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRGWSRPAARKDQWVVGEGWFIS

SEQ ID NO: 146 - protein, 118 aa, Homo sapiens
  misc_feature (1)..(118): RAD52_HUMAN Isoform delta of DNA repair protein RAD52 homolog
MSGTEEAILGGRDSHPAAGGGSVLCFGQCQYTAEEYQAIQKALRQRLGPEYISSRMAGGGQKVCYIEGHRVINLANEMFGYNGWAHSITQQNVGEYALQQWGLLHCPAPAESLLWVRR

SEQ ID NO: 147 - protein, 340 aa, Homo sapiens
  misc_feature (1)..(340): RAD51 [Homo sapiens], CCDS 53931.1
MAMQMQLEANADTSVEEESFGPQPISRLEQCGINANDVKKLEEAGFHTVEAVAYAPKKELINIKGISEAKADKILTESRSVARLECNSVILVYCTLRLSGSSDSPASASRVVGTTGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 148 - protein, 280 aa, Homo sapiens
  misc_feature (1)..(280): CCDS 53932.1
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEIVSEERKRGNQNLQNLRLSLSS

SEQ ID NO: 149 - protein, 350 aa, Homo sapiens
  misc_feature (1)..(350): DNA repair protein RAD51 homolog 2 isoform 2
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQEKP

SEQ ID NO: 150 - protein, 384 aa, Homo sapiens
  misc_feature (1)..(384): DNA repair protein RAD51 homolog 2 isoform 3
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 151 - protein, 135 aa, Homo sapiens
  misc_feature (1)..(135): DNA repair protein RAD51 homolog 3 isoform 2
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLW

SEQ ID NO: 152 - protein, 372 aa, Homo sapiens
  misc_feature (1)..(372): heterogeneous nuclear ribonucleoprotein A1 isoform b
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 153 - protein, 211 aa, Homo sapiens
  misc_feature (1)..(211): SSB1
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 154 - protein, 124 aa, Homo sapiens
  misc_feature (1)..(124): SSB2
MWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 155 - protein, 8 aa, Artificial Sequence
  Synthetic: linker
GGGSGGGS

SEQ ID NO: 156 - protein, 10 aa, Artificial Sequence
  Synthetic: linker
GGGGSGGGGS

SEQ ID NO: 157 - protein, 8 aa, Artificial Sequence
  Synthetic: linker
GGSGGGSG

SEQ ID NO: 158 - protein, 12 aa, Artificial Sequence
  Synthetic: linker
GGSGGGSGGGSG

SEQ ID NO: 159 - protein, 4 aa, Artificial Sequence
  Synthetic: linker
GSAT

SEQ ID NO: 160 - protein, 15 aa, Artificial Sequence
  Synthetic: linker
GGGGSGGGGSGGGGS

SEQ ID NO: 161 - protein, 6 aa, Artificial Sequence
  Synthetic: linker
GGSGGS

The invention claimed is:

1. A method of altering a nucleic acid at a target position in a cell, or a population of cells, the method comprising contacting the cell, or the population of cells, with
    (a) a gRNA molecule;
    (b) a RNA-guided nuclease molecule; and
    (c) a heterologous Repair-Modulating Enzyme Molecule (RMEM);
    wherein the gRNA molecule and the RNA-guided nuclease molecule interact with the nucleic acid, resulting in a cleavage event, and wherein the cleavage event is repaired by at least one DNA repair pathway that is modulated by the RMEM, wherein
    i) the RMEM is Rad52 or TdT, and the RMEM suppresses formation of a deletion in the nucleic acid at the target position in the cell, or in the population of cells;
    ii) the RMEM is Artemis, and the RMEM enhances formation of a deletion in the nucleic acid at the target position in the cell, or in the population of cells;
    iii) the RMEM is Rad52, TdT, Rad51, RPA, or ERCC1, and the RMEM suppresses gene conversion of the nucleic acid at the target position in the cell, or in the population of cells;
    iv) the RMEM is TdT, Rad51, or T5 exonuclease, and the RMEM suppresses gene correction of the nucleic acid at the target position in the cell, or in the population of cells;
    v) the RMEM is Rad52 or 53BP1 dominant negative, and the RMEM enhances gene correction of the nucleic acid at the target position in the cell, or in the population of cells;
    vi) the RMEM is 53BP1 dominant negative or T5 exonuclease, and the RMEM suppresses formation of an insertion in the nucleic acid at the target position in the cell, or in the population of cells; or
    vii) the RMEM is TdT, and the RMEM enhances formation of an insertion in the nucleic acid at the target position in the cell, or in the population of cells,
    and wherein the formation of a deletion in the nucleic acid after repair is suppressed by at least 0.1-fold, the formation of a deletion the nucleic acid after repair is enhanced by at least 0.1-fold, the gene conversion is suppressed by at least 0.1-fold, the gene conversion is enhanced by at least 0.1-fold, the gene correction is suppressed by at least 0.1-fold, the gene correction is enhanced by at least 5-fold, the formation of an insertion in the nucleic acid after repair is suppressed by at least 0.1-fold, and/or the formation of an insertion in the nucleic acid after repair is enhanced by at least 0.1-fold; in the cell or in the population of cells, relative to a cell or a population of cells not contacted with the RMEM,
    thereby altering the nucleic acid at the target position in the cell, or in the population of cells.

2. The method of claim 1, further comprising contacting the cell, or the population of cells, with a second gRNA molecule,
    wherein the second gRNA molecule and the RNA-guided nuclease molecule interact with the nucleic acid, resulting in a second cleavage event, and wherein the second cleavage event is repaired by the at least one DNA repair pathway that is modulated by the RMEM.

3. The method of claim 1, wherein the nucleic acid comprises a deletion after the cleavage event is repaired as compared to the nucleic acid prior to the cleavage event, or wherein the nucleic acid comprises an insertion after the cleavage event is repaired, as compared to the nucleic acid prior to the cleavage event.

4. The method of claim 1, wherein the cleavage event is repaired by gene conversion or gene correction.

5. The method of claim 1, wherein the gRNA molecule is a gRNA nucleic acid, wherein the RNA-guided nuclease molecule is a RNA-guided nuclease nucleic acid, and wherein the RMEM is a RMEM nucleic acid; wherein the gRNA molecule is a gRNA nucleic acid, wherein the RNA-guided nuclease molecule is a RNA-guided nuclease protein, and wherein the RMEM is a RMEM nucleic acid; wherein the gRNA molecule is a gRNA nucleic acid, wherein the RNA-guided nuclease molecule is a RNA-guided nuclease nucleic acid, and wherein the RMEM is a RMEM protein; wherein the gRNA molecule is a gRNA nucleic acid, wherein the RNA-guided nuclease molecule is a RNA-guided nuclease protein, and wherein the RMEM is a RMEM protein; or wherein the cell, or the population of cells, is contacted with the gRNA molecule and the RNA-guided nuclease molecule as a pre-formed complex.

6. The method of claim 1, wherein the RNA-guided nuclease molecule is a Cas9 molecule.

7. The method of claim 1, wherein the cell, or the population of cells, is a human cell, or a population of human cells.

8. The method of claim 6, wherein the RNA-guided nuclease molecule comprises at least 80% identity to an *S. aureus* Cas9 sequence or an *S. pyogenes* Cas9 sequence.

9. The method of claim 6, wherein the RNA-guided nuclease molecule is an enzymatically active Cas9 (eaCas9) molecule or an enzymatically inactive Cas9 (eiCas9) molecule.

10. The method of claim 1, wherein the gRNA molecule interacts with an HBB gene.

11. The method of claim 2, further comprising a third gRNA molecule, wherein the third gRNA molecule and the RNA-guided nuclease molecule interact at the nucleic acid, resulting in a third cleavage event.

12. The method of claim 11, further comprising a fourth gRNA molecule, wherein the fourth gRNA molecule and the RNA-guided nuclease molecule interact at the nucleic acid, resulting in a fourth cleavage event.

13. The method of claim 1, wherein the cleavage event comprises one or more single strand breaks, one or more double strand breaks, or a combination of single strand breaks and double strand breaks.

14. The method of claim 13, wherein the cleavage event comprises any one of the following: one single strand break; two single strand breaks; three single strand breaks; four single strand breaks; one double strand break; two double strand breaks; one single strand break and one double strand break; two single strand breaks and one double strand break; or any combination thereof.

15. The method of claim 1, wherein the target position is a control region, a coding region, a non-coding region, an intron, or an exon of a gene.

16. The method of claim 1, wherein the cell, or the population of cells, is from a subject suffering from a disease or disorder.

17. The method of claim 16, wherein the disease or disorder is a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder cause by aberrant DNA damage repair, or a pain disorder.

18. The method of claim 1, wherein the contacting the cell, or the population of cells, with the gRNA molecule, the RNA-guided nuclease molecule, and the RMEM is performed ex vivo, in vivo, or in vitro.

19. The method of claim 1, further comprising introducing the cell, or the population of cells, into a subject after contacting the cell, or the population of cells, with the gRNA molecule, the RNA-guided nuclease molecule, and the RMEM.

* * * * *